United States Patent
Robins et al.

(10) Patent No.: US 9,371,558 B2
(45) Date of Patent: *Jun. 21, 2016

(54) COMPOSITIONS AND METHOD FOR MEASURING AND CALIBRATING AMPLIFICATION BIAS IN MULTIPLEXED PCR REACTIONS

(71) Applicant: Adaptive Biotechnologies Corp., Seattle, WA (US)

(72) Inventors: Harlan Saul Robins, Seattle, WA (US); Christopher Scott Carlson, Seattle, WA (US); Robert J. Livingston, Seattle, WA (US); Ryan O. Emerson, Seattle, WA (US); Anna M. Sherwood, Seattle, WA (US)

(73) Assignee: Adaptive Biotechnologies Corp., Seattle, WA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/594,007

(22) Filed: Jan. 9, 2015

(65) Prior Publication Data

US 2015/0203897 A1    Jul. 23, 2015

Related U.S. Application Data

(63) Continuation of application No. 14/381,967, filed as application No. PCT/US2013/040221 on May 8, 2013.

(60) Provisional application No. 61/726,489, filed on Nov. 14, 2012, provisional application No. 61/644,294, filed on May 8, 2012.

(51) Int. Cl.
*C12Q 1/68* (2006.01)
*C07H 21/04* (2006.01)

(52) U.S. Cl.
CPC ............ *C12Q 1/6806* (2013.01); *C12Q 1/6851* (2013.01); *C12Q 1/6881* (2013.01); *C12Q 2600/156* (2013.01); *C12Q 2600/16* (2013.01); *C12Q 2600/166* (2013.01)

(58) Field of Classification Search
CPC ............ C12Q 1/6851; C12Q 2537/143; C12Q 2527/143; C12Q 2545/101; C12Q 2545/113; C12Q 1/6806; C12Q 1/6881; C12Q 2600/156; C12Q 2600/16; C12Q 2600/166
See application file for complete search history.

(56) References Cited

U.S. PATENT DOCUMENTS

| | | | |
|---|---|---|---|
| 3,270,960 A | 9/1966 | Phillips | |
| 3,773,919 A | 11/1973 | Boswell et al. | |
| 4,474,754 A | 10/1984 | Shimizu et al. | |
| 4,683,195 A | 7/1987 | Mullis et al. | |
| 4,683,202 A | 7/1987 | Mullis | |
| 4,751,188 A | 6/1988 | Valet | |
| 4,800,159 A | 1/1989 | Mullis et al. | |
| 4,876,189 A | 10/1989 | Schetters | |
| 4,942,124 A | 7/1990 | Church | |
| 4,965,188 A | 10/1990 | Mullis et al. | |
| 5,075,217 A | 12/1991 | Weber | |
| 5,126,022 A | 6/1992 | Soane et al. | |
| 5,149,625 A | 9/1992 | Church et al. | |
| 5,168,038 A | 12/1992 | Tecott et al. | |
| 5,189,147 A | 2/1993 | Saito et al. | |
| 5,210,015 A | 5/1993 | Gelfand et al. | |
| 5,213,960 A | 5/1993 | Chang | |
| 5,231,012 A | 7/1993 | Mosmann et al. | |
| 5,296,351 A | 3/1994 | Morley | |
| 5,298,396 A | 3/1994 | Kotzin et al. | |
| 5,326,696 A | 7/1994 | Chang | |
| 5,336,598 A | 8/1994 | Kotzin et al. | |
| 5,364,759 A | 11/1994 | Caskey et al. | |
| 5,399,491 A | 3/1995 | Kacian et al. | |
| 5,418,134 A | 5/1995 | Morley | |
| 5,449,752 A | 9/1995 | Fujii et al. | |
| 5,498,392 A | 3/1996 | Wilding et al. | |
| 5,506,126 A | 4/1996 | Seed et al. | |
| 5,587,128 A | 12/1996 | Wilding et al. | |
| 5,627,037 A | 5/1997 | Ward | |
| 5,627,052 A | 5/1997 | Schrader | |
| 5,635,354 A | 6/1997 | Kourilsky et al. | |

(Continued)

FOREIGN PATENT DOCUMENTS

| CN | 101225441 A | 7/2008 |
|---|---|---|
| EP | 0303459 A2 | 2/1989 |

(Continued)

OTHER PUBLICATIONS

Abbott, et al. "Design and use of signature primers to detect carry-over of amplified material", J Virol Methods, 46(1):51-59, Abstract Only (1994).

(Continued)

*Primary Examiner* — Teresa E Strzelecka
(74) *Attorney, Agent, or Firm* — Cooley LLP

(57) ABSTRACT

Compositions and methods are described for standardizing the DNA amplification efficiencies of a highly heterogeneous set of oligonucleotide primers as may typically be used to amplify a heterogeneous set of DNA templates that contains rearranged lymphoid cell DNA encoding T cell receptors (TCR) or immunoglobulins (IG). The presently disclosed embodiments are useful to overcome undesirable bias in the utilization of a subset of amplification primers, which leads to imprecision in multiplexed high throughput sequencing of amplification products to quantify unique TCR or Ig encoding genomes in a sample. Provided is a composition comprising a diverse plurality of template oligonucleotides in substantially equimolar amounts, for use as a calibration standard for amplification primer sets. Also provided are methods for identifying and correcting biased primer efficiency during amplification.

27 Claims, 39 Drawing Sheets

(56) References Cited

U.S. PATENT DOCUMENTS

| | | |
|---|---|---|
| 5,635,400 A | 6/1997 | Brenner |
| 5,667,967 A | 9/1997 | Steinman et al. |
| 5,698,396 A | 12/1997 | Pfreundschuh |
| 5,699,798 A | 12/1997 | Hochman et al. |
| 5,742,598 A | 4/1998 | Dunn |
| 5,776,708 A | 7/1998 | Kotzin et al. |
| 5,776,737 A | 7/1998 | Dunn |
| 5,837,447 A | 11/1998 | Gorski |
| 5,846,719 A | 12/1998 | Brenner et al. |
| 5,854,033 A | 12/1998 | Lizardi |
| 5,858,195 A | 1/1999 | Ramsey |
| 5,925,517 A | 7/1999 | Tyagi et al. |
| 5,935,793 A | 8/1999 | Wong |
| 5,969,108 A | 10/1999 | McCafferty et al. |
| 5,981,176 A | 11/1999 | Wallace |
| 5,981,179 A | 11/1999 | Lorinez et al. |
| 6,001,229 A | 12/1999 | Ramsey |
| 6,010,607 A | 1/2000 | Ramsey |
| 6,033,546 A | 3/2000 | Ramsey |
| 6,054,034 A | 4/2000 | Soane et al. |
| 6,087,096 A | 7/2000 | Dau et al. |
| 6,090,592 A | 7/2000 | Adams et al. |
| 6,143,496 A | 11/2000 | Brown et al. |
| 6,172,214 B1 | 1/2001 | Brenner |
| 6,174,670 B1 | 1/2001 | Wittwer et al. |
| 6,258,540 B1 | 7/2001 | Lo et al. |
| 6,258,568 B1 | 7/2001 | Nyren |
| 6,300,070 B1 | 10/2001 | Boles et al. |
| 6,416,948 B1 | 7/2002 | Pilarski et al. |
| 6,440,706 B1 | 8/2002 | Vogelstein et al. |
| 6,458,530 B1 | 10/2002 | Morris et al. |
| 6,489,103 B1 | 12/2002 | Griffiths et al. |
| 6,524,829 B1 | 2/2003 | Seegar |
| 6,569,627 B2 | 5/2003 | Wittwer et al. |
| 6,596,492 B2 | 7/2003 | Avery et al. |
| 6,605,272 B2 | 8/2003 | Novak et al. |
| 6,613,525 B2 | 9/2003 | Nelson et al. |
| 6,667,159 B1 | 12/2003 | Walt |
| 6,753,147 B2 | 6/2004 | Vogelstein et al. |
| 6,787,308 B2 | 9/2004 | Balasubramanian et al. |
| 6,794,499 B2 | 9/2004 | Wengel et al. |
| 6,806,079 B1 | 10/2004 | McCafferty et al. |
| 6,858,412 B2 | 2/2005 | Willis et al. |
| 6,919,434 B1 | 7/2005 | Goto et al. |
| 6,964,850 B2 | 11/2005 | Bevilacqua |
| 7,068,874 B2 | 6/2006 | Wang et al. |
| 7,112,423 B2 | 9/2006 | Van Ness et al. |
| 7,115,400 B1 | 10/2006 | Adessi et al. |
| 7,148,040 B2 | 12/2006 | Meagher et al. |
| 7,157,228 B2 | 1/2007 | Hashmi et al. |
| 7,157,274 B2 | 1/2007 | Bohm et al. |
| 7,208,795 B2 | 4/2007 | Carver et al. |
| 7,232,653 B1 | 6/2007 | Austrup et al. |
| 7,306,906 B2 | 12/2007 | Maruyama et al. |
| 7,313,308 B2 | 12/2007 | Turner et al. |
| 7,323,305 B2 | 1/2008 | Leamon et al. |
| 7,329,731 B2 | 2/2008 | Jakobsen et al. |
| 7,351,578 B2 | 4/2008 | Cheo et al. |
| 7,365,179 B2 | 4/2008 | Brenner |
| 7,371,519 B2 | 5/2008 | Wolber |
| 7,375,211 B2 | 5/2008 | Kou |
| 7,393,665 B2 | 7/2008 | Brenner |
| 7,432,084 B2 | 10/2008 | Shoemaker |
| 7,537,897 B2 | 5/2009 | Brenner et al. |
| 7,544,473 B2 | 6/2009 | Brenner |
| 7,572,582 B2 | 8/2009 | Wengel et al. |
| 7,662,557 B2 | 2/2010 | McCafferty et al. |
| 7,666,604 B2 | 2/2010 | Jakobsen et al. |
| 7,691,994 B2 | 4/2010 | Brewer et al. |
| 7,700,323 B2 | 4/2010 | Willis et al. |
| 7,741,463 B2 | 6/2010 | Gormley et al. |
| 7,749,697 B2 | 7/2010 | Oleksiewicz et al. |
| 7,785,783 B2 | 8/2010 | Morley et al. |
| 7,833,716 B2 | 11/2010 | Becker et al. |
| 7,842,457 B2 | 11/2010 | Berka et al. |
| 7,862,999 B2 | 1/2011 | Zheng et al. |
| 7,879,324 B2 | 2/2011 | Saxon |
| 7,892,550 B2 | 2/2011 | Dennis et al. |
| 7,907,800 B2 | 3/2011 | Foquet et al. |
| 7,915,015 B2 | 3/2011 | Vogelstein et al. |
| 7,956,043 B2 | 6/2011 | Krieg et al. |
| 7,960,116 B2 | 6/2011 | Eid et al. |
| 8,012,690 B2 | 9/2011 | Berka et al. |
| 8,021,842 B2 | 9/2011 | Brenner |
| 8,030,023 B2 | 10/2011 | Adams et al. |
| 8,048,627 B2 | 11/2011 | Dressman et al. |
| 8,053,188 B2 | 11/2011 | Gullberg et al. |
| 8,053,235 B2 | 11/2011 | Buckner et al. |
| 8,137,569 B2 | 3/2012 | Harnack et al. |
| 8,137,936 B2 | 3/2012 | Macevicz |
| 8,153,375 B2 | 4/2012 | Travers et al. |
| 8,158,359 B2 | 4/2012 | Leamon et al. |
| 8,236,503 B2 | 8/2012 | Faham et al. |
| 8,283,294 B2 | 10/2012 | Kastrup et al. |
| 8,309,312 B2 | 11/2012 | Lang et al. |
| 8,313,625 B2 | 11/2012 | Rothberg et al. |
| 8,318,433 B2 | 11/2012 | Brenner |
| 8,394,590 B2 | 3/2013 | Kwong et al. |
| 8,445,205 B2 | 5/2013 | Brenner |
| 8,481,292 B2 | 7/2013 | Casbon et al. |
| 8,507,205 B2 | 8/2013 | Faham et al. |
| 8,628,927 B2 | 1/2014 | Faham et al. |
| 8,685,678 B2 | 4/2014 | Casbon |
| 8,691,510 B2 | 4/2014 | Faham et al. |
| 8,699,361 B2 | 4/2014 | Jim et al. |
| 8,715,967 B2 | 5/2014 | Casbon |
| 8,722,368 B2 | 5/2014 | Casbon |
| 8,728,766 B2 | 5/2014 | Casbon |
| 8,741,606 B2 | 6/2014 | Casbon |
| 8,748,103 B2 | 6/2014 | Faham et al. |
| 8,759,036 B2 | 6/2014 | Wang |
| 8,795,970 B2 | 8/2014 | Faham et al. |
| 8,826,321 B2 | 9/2014 | Cronin et al. |
| 8,835,358 B2 | 9/2014 | Fodor |
| 9,012,148 B2 | 4/2015 | Han et al. |
| 9,043,160 B1 | 5/2015 | Moorhead et al. |
| 9,150,905 B2 | 10/2015 | Robins et al. |
| 2002/0076725 A1 | 6/2002 | Toyosaki-Maeda et al. |
| 2002/0110807 A1 | 8/2002 | Pilarski et al. |
| 2003/0096277 A1 | 5/2003 | Chen |
| 2003/0120061 A1 | 6/2003 | Zhang |
| 2003/0162197 A1 | 8/2003 | Morley et al. |
| 2003/0207300 A1 | 11/2003 | Matray et al. |
| 2004/0033490 A1 | 2/2004 | Laird et al. |
| 2004/0132050 A1 | 7/2004 | Monforte |
| 2004/0146901 A1 | 7/2004 | Morris et al. |
| 2004/0170977 A1 | 9/2004 | Laird |
| 2004/0235061 A1 | 11/2004 | Wilkie et al. |
| 2004/0248172 A1 | 12/2004 | Samoszuk et al. |
| 2005/0037356 A1 | 2/2005 | Gullberg et al. |
| 2005/0064421 A1 | 3/2005 | Gehrmann et al. |
| 2005/0142577 A1 | 6/2005 | Jones et al. |
| 2005/0250147 A1 | 11/2005 | Macevicz |
| 2005/0255482 A1 | 11/2005 | Morley et al. |
| 2005/0260570 A1 | 11/2005 | Mao et al. |
| 2006/0019304 A1 | 1/2006 | Hardenbol et al. |
| 2006/0020397 A1 | 1/2006 | Kermani |
| 2006/0046258 A1 | 3/2006 | Lapidus et al. |
| 2006/0085139 A1 | 4/2006 | Collette et al. |
| 2006/0088876 A1 | 4/2006 | Bauer |
| 2006/0134125 A1 | 6/2006 | Luxembourg et al. |
| 2006/0147925 A1 | 7/2006 | Morley et al. |
| 2006/0199210 A1 | 9/2006 | Weichselbaum et al. |
| 2006/0211030 A1 | 9/2006 | Brenner |
| 2006/0216737 A1 | 9/2006 | Bodeau |
| 2006/0228350 A1 | 10/2006 | Wu et al. |
| 2006/0233812 A1 | 10/2006 | Burnie et al. |
| 2006/0234234 A1 | 10/2006 | Van Dongen et al. |
| 2006/0259248 A1 | 11/2006 | Collette et al. |
| 2006/0263789 A1 | 11/2006 | Kincaid |
| 2007/0020640 A1 | 1/2007 | McCloskey et al. |
| 2007/0020670 A1 | 1/2007 | Loken et al. |
| 2007/0105105 A1 | 5/2007 | Clelland et al. |
| 2007/0117134 A1 | 5/2007 | Kou |

(56) References Cited

U.S. PATENT DOCUMENTS

| | | |
|---|---|---|
| 2007/0160994 A1 | 7/2007 | Lim et al. |
| 2007/0161001 A1 | 7/2007 | Leshkowitz |
| 2007/0172873 A1 | 7/2007 | Brenner et al. |
| 2007/0238099 A1 | 10/2007 | Cohen et al. |
| 2007/0243564 A1 | 10/2007 | Lawson et al. |
| 2007/0264653 A1 | 11/2007 | Berlin et al. |
| 2007/0286849 A1 | 12/2007 | Chaturvedi |
| 2008/0050780 A1 | 2/2008 | Lee et al. |
| 2008/0069770 A1 | 3/2008 | Hercend et al. |
| 2008/0108509 A1 | 5/2008 | Haupl et al. |
| 2008/0166704 A1 | 7/2008 | Marche et al. |
| 2008/0166718 A1 | 7/2008 | Lim et al. |
| 2008/0199916 A1 | 8/2008 | Zheng et al. |
| 2008/0248484 A1 | 10/2008 | Bauer |
| 2008/0274904 A1 | 11/2008 | Gormley et al. |
| 2008/0280774 A1 | 11/2008 | Burczynski et al. |
| 2008/0286777 A1 | 11/2008 | Candeias et al. |
| 2009/0026082 A1 | 1/2009 | Rothberg et al. |
| 2009/0053184 A1 | 2/2009 | Morgan et al. |
| 2009/0098555 A1 | 4/2009 | Roth et al. |
| 2009/0105959 A1 | 4/2009 | Braverman et al. |
| 2009/0181859 A1 | 7/2009 | Muraguchi |
| 2009/0197257 A1 | 8/2009 | Harris |
| 2009/0208955 A1 | 8/2009 | Robins et al. |
| 2009/0215062 A1 | 8/2009 | Lee |
| 2009/0226975 A1 | 9/2009 | Sabot et al. |
| 2009/0233301 A1 | 9/2009 | Lee |
| 2009/0233802 A1 | 9/2009 | Bignell et al. |
| 2009/0253581 A1 | 10/2009 | Van Eijk et al. |
| 2009/0264299 A1 | 10/2009 | Drmanac et al. |
| 2009/0280489 A1 | 11/2009 | Devinder et al. |
| 2009/0286237 A1 | 11/2009 | Fitzgerald et al. |
| 2009/0298060 A1 | 12/2009 | Lal et al. |
| 2010/0008920 A1 | 1/2010 | Schneck et al. |
| 2010/0021896 A1 | 1/2010 | Han |
| 2010/0021984 A1 | 1/2010 | Edd |
| 2010/0027896 A1 | 2/2010 | Geva et al. |
| 2010/0034834 A1 | 2/2010 | Robbins et al. |
| 2010/0035764 A1 | 2/2010 | Chen |
| 2010/0040606 A1 | 2/2010 | Lantto et al. |
| 2010/0042329 A1 | 2/2010 | Hood et al. |
| 2010/0105886 A1 | 4/2010 | Woudenberg |
| 2010/0137143 A1 | 6/2010 | Rothberg et al. |
| 2010/0151471 A1 | 6/2010 | Faham et al. |
| 2010/0159456 A1 | 6/2010 | Albitar |
| 2010/0167353 A1 | 7/2010 | Walder et al. |
| 2010/0173394 A1 | 7/2010 | Colston, Jr. |
| 2010/0255471 A1 | 10/2010 | Clarke |
| 2010/0261204 A1 | 10/2010 | Goolsby et al. |
| 2010/0267043 A1 | 10/2010 | Braverman |
| 2010/0285975 A1 | 11/2010 | Mathies |
| 2010/0300895 A1 | 12/2010 | Nobile et al. |
| 2010/0304982 A1 | 12/2010 | Hinz et al. |
| 2010/0323348 A1 | 12/2010 | Hamady et al. |
| 2010/0330571 A1 | 12/2010 | Robins et al. |
| 2011/0003291 A1 | 1/2011 | Pasqual et al. |
| 2011/0014659 A1 | 1/2011 | Balazs et al. |
| 2011/0097712 A1 | 4/2011 | Cantor et al. |
| 2011/0104671 A1 | 5/2011 | Dornan et al. |
| 2011/0105343 A1 | 5/2011 | Puledran et al. |
| 2011/0129830 A1 | 6/2011 | Ladner et al. |
| 2011/0160078 A1 | 6/2011 | Fodor et al. |
| 2011/0195253 A1 | 8/2011 | Hinz et al. |
| 2011/0207134 A1 | 8/2011 | Faham et al. |
| 2011/0207135 A1 | 8/2011 | Faham et al. |
| 2011/0207617 A1 | 8/2011 | Faham et al. |
| 2011/0251099 A1 | 10/2011 | Visvanathan et al. |
| 2012/0035062 A1 | 2/2012 | Schultz et al. |
| 2012/0058902 A1 | 3/2012 | Livingston et al. |
| 2012/0071331 A1 | 3/2012 | Casbon et al. |
| 2012/0073667 A1 | 3/2012 | Schultz et al. |
| 2012/0122714 A1 | 5/2012 | Samuels |
| 2012/0135409 A1 | 5/2012 | Faham |
| 2012/0143531 A1 | 6/2012 | Davey et al. |
| 2012/0172241 A1 | 7/2012 | Rearick et al. |
| 2012/0173158 A1 | 7/2012 | Hubbell |
| 2012/0220466 A1 | 8/2012 | Fire et al. |
| 2013/0005584 A1 | 1/2013 | Faham |
| 2013/0017957 A1 | 1/2013 | Faham et al. |
| 2013/0065768 A1 | 3/2013 | Zheng |
| 2013/0116130 A1 | 5/2013 | Fu |
| 2013/0123120 A1 | 5/2013 | Zimmermann et al. |
| 2013/0136799 A1 | 5/2013 | Faham et al. |
| 2013/0150252 A1 | 6/2013 | Faham |
| 2013/0196328 A1 | 8/2013 | Pepin |
| 2013/0196861 A1 | 8/2013 | Quake |
| 2013/0202718 A1 | 8/2013 | Pepin |
| 2013/0236895 A1 | 9/2013 | Faham |
| 2013/0253842 A1 | 9/2013 | Sherwood et al. |
| 2013/0267427 A1 | 10/2013 | Faham |
| 2013/0288237 A1 | 10/2013 | Robins et al. |
| 2013/0302801 A1 | 11/2013 | Asbury |
| 2013/0324422 A1 | 12/2013 | Faham et al. |
| 2013/0344066 A1 | 12/2013 | Faham |
| 2014/0057799 A1 | 2/2014 | Johnson et al. |
| 2014/0094376 A1 | 4/2014 | Han |
| 2014/0127699 A1 | 5/2014 | Han |
| 2014/0155277 A1 | 6/2014 | Wiley |
| 2014/0186848 A1 | 7/2014 | Robins et al. |
| 2014/0194295 A1 | 7/2014 | Robins et al. |
| 2014/0206548 A1 | 7/2014 | Robins et al. |
| 2014/0206549 A1 | 7/2014 | Robins et al. |
| 2014/0213463 A1 | 7/2014 | Robins et al. |
| 2014/0221220 A1 | 8/2014 | Robins et al. |
| 2014/0234835 A1 | 8/2014 | Pepin |
| 2014/0235454 A1 | 8/2014 | Faham |
| 2014/0255929 A1 | 9/2014 | Zheng |
| 2014/0255944 A1 | 9/2014 | Carlton |
| 2014/0256567 A1 | 9/2014 | Robins et al. |
| 2014/0256592 A1 | 9/2014 | Faham |
| 2014/0315725 A1 | 10/2014 | Faham et al. |
| 2014/0322716 A1 | 10/2014 | Robins et al. |
| 2014/0336059 A1 | 11/2014 | Faham et al. |
| 2014/0342360 A1 | 11/2014 | Faham et al. |
| 2014/0342367 A1 | 11/2014 | Faham et al. |
| 2014/0349883 A1 | 11/2014 | Faham |
| 2014/0356339 A1 | 12/2014 | Faham et al. |
| 2015/0017652 A1 | 1/2015 | Robins et al. |
| 2015/0031043 A1 | 1/2015 | Faham et al. |
| 2015/0031553 A1 | 1/2015 | Faham et al. |
| 2015/0031555 A1 | 1/2015 | Johnson et al. |
| 2015/0038346 A1 | 2/2015 | Faham et al. |
| 2015/0051089 A1 | 2/2015 | Robins et al. |
| 2015/0065352 A1 | 3/2015 | Faham et al. |
| 2015/0133317 A1 | 5/2015 | Robinson et al. |
| 2015/0167080 A1 | 6/2015 | Moorhead et al. |
| 2015/0247182 A1 | 9/2015 | Faham et al. |
| 2015/0247198 A1 | 9/2015 | Klinger et al. |
| 2015/0247201 A1 | 9/2015 | Faham et al. |
| 2015/0252419 A1 | 9/2015 | Moorhead et al. |
| 2015/0252422 A1 | 9/2015 | Faham et al. |
| 2015/0259734 A1 | 9/2015 | Asbury et al. |
| 2015/0275296 A1 | 10/2015 | Klinger et al. |
| 2015/0299785 A1 | 10/2015 | Livingston et al. |
| 2015/0299786 A1 | 10/2015 | Robins et al. |

FOREIGN PATENT DOCUMENTS

| | | |
|---|---|---|
| EP | 0799897 A1 | 10/1997 |
| EP | 1544308 A1 | 6/2005 |
| EP | 1549764 B1 | 7/2005 |
| EP | 0972081 B1 | 6/2007 |
| EP | 1544308 B1 | 1/2009 |
| EP | 2062982 A1 | 5/2009 |
| EP | 2088432 A1 | 8/2009 |
| EP | 2364368 B1 | 1/2014 |
| JP | 4262799 A | 9/1992 |
| JP | 2002-503954 A | 2/2001 |
| JP | 2005-245381 A | 9/2005 |
| JP | 2006-501842 A | 1/2006 |
| JP | 2007-515955 A | 6/2007 |
| JP | 2007-536939 A | 12/2007 |
| JP | 2008-099588 A | 5/2008 |
| WO | WO 93/01838 A1 | 2/1993 |

(56) References Cited

FOREIGN PATENT DOCUMENTS

| | | |
|---|---|---|
| WO | WO 95/28481 A1 | 10/1995 |
| WO | WO 97/13877 A1 | 4/1997 |
| WO | WO 97/18330 A1 | 5/1997 |
| WO | WO 97/46706 A1 | 12/1997 |
| WO | WO 98/01738 A2 | 1/1998 |
| WO | WO 98/44151 A1 | 10/1998 |
| WO | WO 99/19717 A1 | 4/1999 |
| WO | WO 99/20798 A1 | 4/1999 |
| WO | WO 02/24322 A2 | 3/2002 |
| WO | WO 03/008624 A2 | 1/2003 |
| WO | WO 03/044225 A2 | 5/2003 |
| WO | WO 03/052101 A1 | 6/2003 |
| WO | WO 03/059155 A2 | 7/2003 |
| WO | WO 03/044225 A3 | 12/2003 |
| WO | WO 2004/003820 A2 | 1/2004 |
| WO | WO 03/059155 A3 | 3/2004 |
| WO | WO 2004/033728 A2 | 4/2004 |
| WO | WO 2004/034031 A2 | 4/2004 |
| WO | WO 2004/044209 A1 | 5/2004 |
| WO | WO 2004/046098 A2 | 6/2004 |
| WO | WO 2004/063706 A2 | 7/2004 |
| WO | WO 2004/033728 A3 | 8/2004 |
| WO | WO 2004/046098 A3 | 8/2004 |
| WO | WO 2004/096985 A2 | 11/2004 |
| WO | WO 2005/005651 A2 | 1/2005 |
| WO | WO 2004/063706 A3 | 5/2005 |
| WO | WO 2005/042774 A2 | 5/2005 |
| WO | WO 2005/042774 A3 | 6/2005 |
| WO | WO 2005/053603 A2 | 6/2005 |
| WO | WO 2005/056828 A1 | 6/2005 |
| WO | WO 2005/059176 A1 | 6/2005 |
| WO | WO 2004/003820 A3 | 7/2005 |
| WO | WO 2005/084134 A2 | 9/2005 |
| WO | WO 2005/005651 A3 | 11/2005 |
| WO | WO 2005/111242 A2 | 11/2005 |
| WO | WO 2005/113803 A1 | 12/2005 |
| WO | WO 2004/096985 A3 | 3/2006 |
| WO | WO 2004/034031 A3 | 7/2006 |
| WO | WO 2006/076205 A2 | 7/2006 |
| WO | WO 2005/053603 A3 | 9/2006 |
| WO | WO 2006/110855 A2 | 10/2006 |
| WO | WO 2006/116155 A2 | 11/2006 |
| WO | WO 2006/138284 A2 | 12/2006 |
| WO | WO 2006/116155 A3 | 11/2007 |
| WO | WO 2007/134220 A2 | 11/2007 |
| WO | WO 2008/026927 A2 | 3/2008 |
| WO | WO 2008/026927 A3 | 3/2008 |
| WO | WO 2008/039694 A2 | 4/2008 |
| WO | WO 2008/039694 A3 | 4/2008 |
| WO | WO 2008/108803 A2 | 9/2008 |
| WO | WO 2008/108803 A3 | 12/2008 |
| WO | WO 2008/147879 A1 | 12/2008 |
| WO | WO 2009/015296 A1 | 1/2009 |
| WO | WO 2009/017678 A2 | 2/2009 |
| WO | WO 2009/019657 A2 | 2/2009 |
| WO | WO 2009/019657 A3 | 2/2009 |
| WO | WO 2009/021215 A1 | 2/2009 |
| WO | WO 2005/084134 A3 | 4/2009 |
| WO | WO 2006/076205 A3 | 4/2009 |
| WO | WO 2009/045898 A2 | 4/2009 |
| WO | WO 2009/070767 A2 | 6/2009 |
| WO | WO 2009/095567 A2 | 8/2009 |
| WO | WO 2009/108860 A2 | 9/2009 |
| WO | WO 2009/108866 A2 | 9/2009 |
| WO | WO 2009/070767 A3 | 10/2009 |
| WO | WO 2009/108866 A3 | 10/2009 |
| WO | WO 2009/137255 A2 | 11/2009 |
| WO | WO 2009/137832 A2 | 11/2009 |
| WO | WO 2009/145925 A1 | 12/2009 |
| WO | WO 2009/151628 A2 | 12/2009 |
| WO | WO 2009/151628 A3 | 12/2009 |
| WO | WO 2009/152928 A2 | 12/2009 |
| WO | WO 2009/158521 A2 | 12/2009 |
| WO | WO 2009/158521 A3 | 12/2009 |
| WO | WO 2009/108860 A3 | 1/2010 |
| WO | WO 2009/137255 A3 | 1/2010 |
| WO | WO 2010/011894 A1 | 1/2010 |
| WO | WO 2009/137832 A3 | 4/2010 |
| WO | WO 2010/036352 A1 | 4/2010 |
| WO | WO 2010/053587 A2 | 5/2010 |
| WO | WO 2010/151416 A1 | 12/2010 |
| WO | WO 2011/083296 A1 | 7/2011 |
| WO | WO 2011/083996 A2 | 7/2011 |
| WO | WO 2011/106738 A2 | 9/2011 |
| WO | WO 2011/106738 A3 | 9/2011 |
| WO | WO 2011/107595 A1 | 9/2011 |
| WO | WO 2011/139371 A1 | 11/2011 |
| WO | WO 2011/139372 A1 | 11/2011 |
| WO | WO 2011/140433 A2 | 11/2011 |
| WO | WO 2012/027503 A2 | 3/2012 |
| WO | WO 2012/048340 A2 | 4/2012 |
| WO | WO 2012/048340 A3 | 4/2012 |
| WO | WO 2012/048341 A1 | 4/2012 |
| WO | WO 2012/055929 A1 | 5/2012 |
| WO | WO 2012/061832 A1 | 5/2012 |
| WO | WO 2012/083069 A2 | 6/2012 |
| WO | WO 2012/083225 A2 | 6/2012 |
| WO | WO 2012/142213 A2 | 10/2012 |
| WO | WO 2012/148497 A2 | 11/2012 |
| WO | WO 2012/159754 A2 | 11/2012 |
| WO | WO 2013/033721 A1 | 3/2013 |
| WO | WO 2013/036459 A2 | 3/2013 |
| WO | WO 2013/055595 A1 | 4/2013 |
| WO | WO 2013/059725 A1 | 4/2013 |
| WO | WO 2013/066726 A1 | 5/2013 |
| WO | WO 2013/085855 A1 | 6/2013 |
| WO | WO 2013/086450 A1 | 6/2013 |
| WO | WO 2013/086462 A1 | 6/2013 |
| WO | WO 2013/090390 A2 | 6/2013 |
| WO | WO 2013/090469 A1 | 6/2013 |
| WO | WO 2013/096480 A2 | 6/2013 |
| WO | WO 2013/130512 A2 | 9/2013 |
| WO | WO 2013/131074 A1 | 9/2013 |
| WO | WO 2013/134162 A2 | 9/2013 |
| WO | WO 2013/134302 A1 | 9/2013 |
| WO | WO 2013/155119 A1 | 10/2013 |
| WO | WO 2013/158936 A1 | 10/2013 |
| WO | WO 2013/169957 A1 | 11/2013 |
| WO | WO 2013/181428 A2 | 12/2013 |
| WO | WO 2013/188471 A2 | 12/2013 |
| WO | WO 2013/188831 A1 | 12/2013 |
| WO | WO 2014/018460 A1 | 1/2014 |
| WO | WO 2014/026031 A1 | 2/2014 |
| WO | WO 2014/062945 A1 | 4/2014 |
| WO | WO 2014/062959 A1 | 4/2014 |
| WO | WO 2014/066184 A1 | 5/2014 |
| WO | WO 2014/130685 A1 | 8/2014 |
| WO | WO 2015/002908 A1 | 1/2015 |
| WO | WO 2015/013461 A2 | 1/2015 |
| WO | WO 2015/058159 A1 | 4/2015 |

OTHER PUBLICATIONS

Altschul, et al. "Basic local alignment search tool", J Mol Biol., 215(3):403-410 (1990).
Arden, et al. "Human T-cell receptor variable gene segment families", *Immunogenetics*, 42(6):455-500, Abstract Only (1995).
Armand, P. et al., "Detection of circulating tumour DNA in patients with aggressive B-cell non-Hodgkin lymphoma", Brit. J. Haematol., vol. 163, pp. 123-126 (2013).
Aslanzadeh. "Preventing PCR amplification carryover contamination in a clinical laboratory", Ann Clin Lab Sci., 34(4):389-396 (2004).
Barbas, et al. "Assembly of combinatorial antibody libraries on phage surfaces: the gene III site", PNAS, 88(18):7978-7982, Abstract Only (1991).
Barker, et al. "A second type II restriction endonuclease from Thermus aquaticus with an unusual sequence specificity", Nucleic Acids Res., 12(14):5567-5581 (1984).
Baum and McCune et al. "Direct measurement of T-cell receptor repertoire diversity with AmpliCot", Nat Methods, 3(11):895-901 (2006).

(56) References Cited

OTHER PUBLICATIONS

Benecke. "DNA typing in forensic medicine and in criminal investigations: a current survey", Naturwissenschaften, 84(5)181-188 (1997).
Berger, et al. "The clonotypic T cell receptor is a source of tumor-associated antigens in cutaneous T cell lymphoma", Annals of the New York Academy of Sciences, 941:106-122, Abstract Only (2001).
Berzofsky, et al. "Progress on new vaccine strategies for the immunotherapy and prevention of cancer", J Clin Invest., 113(11):1515-1525 (2004).
Biagi, et al. "Responses to human CD40 ligand/human interleukin-2 autologo cell vaccine in patients with B-cell chronic lymphocytic leukemia", Clin Cancer Res., 11(19 Pt 1):6916-6923 (2005).
Borst, et al. "False-positive results and contamination in nucleic acid amplification assays: suggestions for a prevent and destroy strategy", Eur J Clin Microbiol Infect Dis., 23(4):289-299, Abstract Only (2004). Epub Mar. 10, 2004.
Bousso. "Generation of MHC-peptide tetramers: a new opportunity for dissecting T-cell immune responses", Microbes Infect., 2(4):425-429, Abstract Only (2000).
Bravo and Irizarry. "Model-Based Quality Assessment and Base-Calling for Second-Generation Sequencing Data", Biometrics, 66(3): 665-674 (2010).
Brenner, et al. "In vitro cloning of complex mixtures of DNA on microbeads: physical separation of differentially expressed cDNAs", PNAS, 97(4):1665-1670 (2000).
Brody, et al. "Active and passive immunotherapy for lymphoma: proving principles and improving results", J Clin Oncol., 29(14):1864-1875, Abstract Only (2011). doi: 10.1200/JCO.2010. 33.4623. Epub Apr. 11, 2011.
Brody, et al., "Immunotransplant for mantle cell lymphoma: Phase I/II study preliminary results", Journal of Clinical Oncology, ASCO Annual Meeting Abstracts Part 1, vol. 29, No. 15, 1 page (2011).
Brody, et al. "Lymphoma immunotherapy: vaccines, adoptive cell transfer and immunotransplant", Immunotherapy, 1(5):809-824 (2009). doi: 10.2217/imt.09.50.
Brown, et al. "Current techniques for single-cell lysis", J. R. Soc. Interface, 5:S131-S138 (2008).
Buccisano, et al. "Prognostic and therapeutic implications of minimal residual disease detection in acute myeloid leukemia", Blood, 119(2):332-341 (2012). doi: 10.1182/blood-2011-08-363291. Epub Oct. 28, 2011.
Buccisano, et al. "Monitoring of minimal residual disease in acute myeloid leukemia", Curr Opin Oncol., 21(6):582-588, Abstract Only (2009). doi: 10.1097/CCO.0b013e3283311856.
Campana, et al. "Role of minimal residual disease monitoring in adult and pediatric acute lymphoblastic leukemia", Hematol Oncol Clin North Am., 23(5):1083-1098 (2009). doi: 10.1016/j.hoc.2009.07. 010.
Carlotti, et al. "Transformation of follicular lymphoma to diffuse large B-cell lymphoma may occur by divergent evolution from a common progenitor cell or by direct evolution from the follicular lymphoma clone", Blood, 113(15):3553-3557 (2009). doi: 10.1182/blood-2008-08-174839. Epub Feb. 6, 2009.
Casali, et al. "Human monoclonals from antigen-specific selection of B lymphocytes and transformation by EBV", Science, 234(4775):476-479, Abstract Only (1986).
Catherwood, MA. et al., "Improved clonality assessment in germinal centre/post germinal centre non-Hodgkin's lymphomas with high rates of somatic hypermutation", J. Clin. Pathol., 60:524-528, Abstract (2007).
Chattopadhyay, et al. "A live-cell assay to detect antigen-specific CD4+ T cells with diverse cytokine profiles", Nat Med., 11(10):1113-1117 (2005). Epub Sep. 25, 2005.
Chen, et al. "Microfluidic cell sorter with integrated piezoelectric actuator", Biomed Microdevices, 11(6):1223-1231 (2009). doi: 10.1007/s10544-009-9341-5.
Chen, et al. "Total Gene Synthesis: Novel Single-Step and Convergent Strategies Applied to the Construction of a 779 Base Pair Bacteriorhodopsis", Gene. J. Am. Chem Soc., 116:8799-8800, Abstract Only (1994).
Chiu, et al. "Non-invasive prenatal assessment of trisomy 21 by multiplexed maternal plasma DNA sequencing: large scale validity study", BMJ, 342:c7401, 9 pages (2011). doi: 10.1136/bmj.c7401.
Cleary, et al. "Production of complex nucleic acid libraries using highly parallel in situ oligonucleotide synthesis", Nat Methods, 1(3):241-248 (2004). Epub Nov. 18, 2004.
Cronin, et al. "Comprehensive next-generation cancer genome sequencing in the era of targeted therapy and personalized oncology", Biomark Med., 5(3):293-305 (2011). (Abstract only). doi: 10.2217/bmm.11.37.
Deiman, et al. "Characteristics and applications of nucleic acid sequence-based amplification (NASBA)", Mol Biotechnol., 20(2):163-179, Abstract Only (2002).
Diehl, et al. "BEAMing: single-molecule PCR on microparticles in water-in-oil emulsions", Nat Methods, 3(7):551-559, Abstract Only (2006).
Ding, et al. "Clonal evolution in relapsed acute myeloid leukaemia revealed by whole-genome sequencing", Nature, 481(7382):506-510 (2012). doi: 10.1038/nature10738.
Dressman, et al. "Transforming single DNA molecules into fluorescent magnetic particles for detection and enumeration of genetic variations", PNAS, 100(15):8817-8822 (2003). Epub Jul. 11, 2003.
Eichler, et al. "Haplotype and interspersion analysis of the FMR1 CGG repeat identifies two different mutational pathways for the origin of the fragile X syndrome", Hum Mol Genet., 5(3):319-330 (1996).
Eichler, et al. "Length of uninterrupted CGG repeats determines instability in the FMR1 gene", Nat Genet., 8(1):88-94, Abstract Only (1994).
Eis, et al. "An invasive cleavage assay for direct quantitation of specific RNAs", Nat Biotechnol., 19(7):673-676, Abstract Only (2001).
EP Application No. 11777704.5, European Search Report dated Jul. 26, 2013, 6 pages.
Ferrero, et al. "Multiple myeloma shows no intra-disease clustering of immunoglobulin heavy chain genes", Haematologica, 97(6):849-853 (2012). doi: 10.3324/haematol.2011.052852. Epub Dec. 29, 2011.
Frampton, et al. "Development and validation of a clinical cancer genomic profiling test based on massively parallel DNA sequencing", Nat Biotechnol., 31(11):1023-1031 (2013). doi: 10.1038/nbt. 2696. Epub Oct. 20, 2013.
Fuller, et al. "The challenges of sequencing by synthesis", Nat Biotechnol., 7(11):1013-23 (2009) (Abstract only). doi: 10.1038/nbt. 1585. Epub Nov. 6, 2009.
Gauss, et al. "Mechanistic constraints on diversity in human V(D)J recombination", Mol Cell Biol., 16(1):258-269 (1996).
Gawad, et al. "Massive evolution of the immunoglobulin heavy chain loc in children with B precursor acute lymphoblastic leukemia", Blood, 120(22):4407-4417 (2012). doi: 10.1182/blood-2012-05-429811. Epub Aug. 28, 2012.
Godelaine, et al. "Polyclonal CTL responses observed in melanoma patients vaccinated with dendritic cells pulsed with a MAGE-3.A1 peptide", J Immunol., 171(9):4893-4897 (2003).
Gonzalez et al., "Incomplete DJH rearrangements as a novel tumor target for minimal residual disease quantitation in multiple myeloma using real-time PCR", Leukemia, 17:1051-1057 (2003).
Gottenberg, et al. "Markers of B-lymphocyte activation are elevated in patients with early rheumatoid arthritis and correlated with disease activity in the ESPOIR cohort", Arthritis Res Ther., 11(4):R114 (2009). doi: 10.1186/ar2773. Epub Jul. 23, 2009.
Gratama, et al. "Measuring antigen-specific immune responses", 2008 update. Cytometry A., 73(11):971-974 (2008). doi: 10.1002/cyto.a.20655.
Greenberg, et al. "Profile of immunoglobulin heavy chain variable gene repertoires and highly selective detection of malignant clonotypes in acute lymphoblastic leukemia" J Leukoc Biol., 57(6):856-864 (1995).

(56) References Cited

OTHER PUBLICATIONS

Greenman, et al. "Patterns of somatic mutation in human cancer genomes", Nature, 446(7132):153-158 (2007).
Gribben, JG. "Stem cell transplantation in chronic lymphocytic leukemia", Biol. Blood Marrow Transplant., 15(1 Suppl):53-8 (2009). doi: 10.1016/j.bbmt.2008.10.022.
Gulliksen, et al. "Real-time nucleic acid sequence-based amplification in nanoliter volumes", Anal Chem., 76(1):9-14, Abstract Only (2004).
Hadrup, et al. "Parallel detection of antigen-specific T-cell responses by multidimensional encoding of MHC multimers", Nat Methods, 6(7):520-526 (2009) (Abstract Only). doi: 10.1038/nmeth.1345. Epub Jun. 21, 2009.
Hanahan, et al. "Hallmarks of cancer: the next generation", Cell, 144(5):646-674 (2011). doi: 10.1016/j.cell.2011.02.013.
Hill, et al. "Using ecological diversity measures with bacterial communities", FEMS Microbiol Ecol., 43(1):1-11 (2003). doi: 10.1111/j.1574-6941.2003.tb01040.x.
Hirohata, et al. "Regulation of human B cell function by sulfasalazine and its metabolites", Int Immunopharmacol., 2(5):631-640, Abstract Only (2002).
Hoogenboom, et al. "Multi-subunit proteins on the surface of filamentophage: methodologies for displaying antibody (Fab) heavy and light chains", Nucleic Acids Res., 19(15):4133-4137 (1991).
Hoogendoorn, et al. "Primary allogeneic T-cell responses against mantle cell lymphoma antigen-presenting cells for adoptive immunotherapy after stem cell transplantation", Clin Cancer Res., 11(14):5310-5318 (2005).
Hoos, et al. "Improved endpoints for cancer immunotherapy trials", J Natl Cancer Inst., 102(18):1388-1397 (2010). doi: 10.1093/jnci/djq310. Epub Sep. 8, 2010.
Hoover and Lubkowski. "DNAWorks: an automated method for designing oligonucleotides for PCR-based gene synthesis", Nucleic Acids Res., 30(10):e43, 7 pages (2002).
Huang, et al. "Isolation of cell-free DNA from maternal plasma using manual and automated systems", Methods Mol Biol., 444:203-208, Abstract Only (2008). doi: 10.1007/978-1-59745-066-9_15.
Huse, et al. "Generation of a large combinatorial library of the immunoglobulin repertoire in phage lambda", Science, 246(4935):1275-1281, Abstract Only (1989).
Iancu, et al. "Profile of a serial killer: cellular and molecular approaches to study individual cytotoxic T-cells following therapeutic vaccination", J Biomed Biotechnol., 2011:452606 (2011). doi: 10.1155/2011/452606. Epub Nov. 14, 2010.
Illumina. Genome analyzer pipeline software version 1.0 user guide. Part #1004759, 176 pages (2008).
Illumina. TruSeq Sample Preparation Kit and Data Sheet. Illumina, Inc., San Diego, CA, 4 pages (2011).
Jaffe, et al. "Classification of lymphoid neoplasms: the microscope as a tool for disease discovery", Blood, 112(12):4384-4399 (2008). doi: 10.1182/blood-2008-07-077982.
Jung, et al. "Unraveling V(D)J recombination; insights into gene regulation", Cell, 116(2):299-311 (2004).
Kircher, et al. "Improved base calling for the Illumina Genome Analyzer using machine learning strategies", Genome Biol., 10(8):R83, 9 pages (2009). doi: 10.1186/gb-2009-10-8-r83. Epub Aug. 14, 2009.
Klebanoff, et al. "Therapeutic cancer vaccines: are we there yet?", Immunol Rev., 239(1):27-44 (2011). doi: 10.1111/j.1600-065X.2010.00979.x.
Klenerman, et al. "Tracking T cells with tetramers: new tales from new tools", Nat Rev Immunol., 2(4):263-272 (2002).
Kneba, et al. "Characterization of clone-specific rearrangement T-cell receptor gamma-chain genes in lymphomas and leukemias by the polymerase chain reaction and DNA sequencing", Blood, 84(2):574-581 (1994).
Kohlmann, et al. "Integration of next-generation sequencing into clinical practice: are we there yet?", Semin Oncol., 39(1):26-36, Abstract Only (2012). doi: 10.1053/j.seminoncol.2011.11.008.

Krueger, et al. "Large scale loss of data in low-diversity illumina sequencing libraries can be recovered by deferred cluster calling", PLoS One, 6(1):e16607, 7 pages (2011). doi: 10.1371/journal.pone.0016607.
Ku, et al. "Exome sequencing: dual role as a discovery and diagnostic tool", Ann Neurol., 71(1):5-14, Abstract Only (2012). doi: 10.1002/ana.22647.
Kumar, et al. "PEG-labeled nucleotides and nanopore detection for single molecule DNA sequencing by synthesis", Sci Rep., 2:684, 8 pages (2012). Epub Sep. 21, 2012.
Kwak, et al. "Induction of immune responses in patients with B-cell lymphoma against the surface-immunoglobulin idiotype expressed by their tumors", N Engl J Med., 327(17):1209-1215 (1992).
Ladetto, et al., "Next-generation sequencing and real-time quantitative PCR for minimal residual disease (MRD) detection using the immunoglobulin heavy chain variable region: A methodical comparison in acute lymphoblastic leukemia (ALL), mantle cell lymphoma (MCL) and multiple myeloma (MM)", Blood, vol. 120, No. 21, Abstract 788 (Conference Abstract), Entire Abstract (2012).
Lefranc. "IMGT, the international ImMunoGeneTics database", Nucleic Acids Res., 31(1):307-310 (2003).
Lennon, et al. "A scalable, fully automated process for construction of sequence-ready barcoded libraries for 454", Genome Biol., 11(2):R15, 9 pages (2010). doi: 10.1186/gb-2010-11-2-r15. Epub Feb. 5, 2010.
Leary, et al. "Development of personalized tumor biomarkers ing massively parallel sequencing", Sci Transl Med., 2(20):20ra14 (2010). doi: 10.1126/scitranslmed.3000702.
Leproust, et al. "Synthesis of high-quality libraries of long (150mer) oligonucleotides by a novel depurination controlled process", Nucleic Acids Res., 38(8):2522-2540 (2010). doi: 10.1093/nar/gkq163. Epub Mar. 22, 2010.
Lessin, et al. "Molecular diagnosis of cutaneous T-cell lymphoma: polymerase chain reaction amplification of T-cell antigen receptor beta-chain gene rearrangements", J Invest Dermatol., 96(3):299-302 (1991).
Li, et al. "β cell-specific CD4+ T cell clonotypes in peripheral blood and the pancreatic islets are distinct", J Immunol., 183(11):7585-7591 (2009). doi: 10.4049/jimmunol.0901587. Epub Nov. 16, 2009.
Logan, et al., "High-throughput immunoglobulin gene sequencing quantifies minimal residual disease in CLL with 10e-6 sensitivity and strongly predicts relapse after allogeneic hematopoietic cell transplantation", Blood, vol. 118 (21), Abstract 2542 (2011).
Logan, et al., "Massively parallel immunoglobulin gene sequencing provides ultra-sensitive minimal residual disease detection and predicts post-transplant relapse in acute lymphoblastic leukemia by three to six months", Blood, vol. 118 (21), Abstract 4104 (2011).
Lossos, et al. "Transformation of follicular lymphoma to diffuse large-cell lymphoma: alternative patterns with increased or decreased expression of c-myc and its regulated genes", PNAS, 99(13):8886-8891 (2002).
Lowman, et al. "Monovalent phage display: a method for selecting variant proteins from random libraries", Methods: A Companion to Methods in Enzymology, 3:205-216, Abstract Only (1991).
Lyamichev, et al. "Polymorphism identification and quantitative detection of genomic DNA by invasive cleavage of oligonucleotide probes", Nat Biotechnol., 17(3):292-396 (1999).
Mackay, et al. "Real-time PCR in virology", Nucleic Acids Res., 30(6):1292-305 (2002).
Malyguine, et al. "ELISPOT Assay for Monitoring Cytotoxic T Lymphocytes (CTL) Activity in Cancer Vaccine Clinical Trials", Cells, 1(2):111-126 (2012). doi: 10.3390/cells1020111.
Martin-Jimenez, et al. "Molecular characterization of heavy chain immunoglobulin gene rearrangements in Waldenström's macroglobulinemia and IgM monoclonal gammopathy of undetermined significance", Haematologica, 92(5):635-642 (2007).
Matsubara, et al. "Microchamber array based DNA quantification and specific sequence detection from a single copy via PCR in nanoliter volumes", Biosens Bioelectron, 20(8):1482-1490, Abstract Only (2005).
Mazumder, et al., "Detection of multiple myeloma cells in peripheral blood using high-throughput sequencing assay" Blood, vol. 120, No. 21, Abstract 321 (Conference Abstract), Entire Abstract (2012).

(56) References Cited

OTHER PUBLICATIONS

Meier, et al. "The influence of different stimulation conditions on the assessment of antigen-induced CD154 expression on CD4+ T cells", Cytometry A., (11):1035-1042 (2008). doi: 10.1002/cyto.a.20640.

Mitra, et al. "Fluorescent in situ sequencing on polymerase colonies", *Anal Biochem.*, 320(1):55-65, Abstract Only (2003).

Miyashita, et al. "N-Methyl substituted 2',4'—BNANC: a highly nuclease-resistant nucleic acid analogue with high-affinity RNA selective hybridization", Chem Commun (Camb), (36):3765-3767, Abstract Only (2007). Epub Jul. 9, 2007.

Moen, et al. "Immunoglobulin G and A antibody responses to Bacteroides forsyth and Prevotella intermedia in sera and synovial fluids of arthritis patients", Clin Diagn Lab Immunol., 10(6):1043-1050 (2003).

Molloy, et al. "Soluble T cell receptors: novel immunotherapies", *Curr Opin Pharmacol.*, 5(4):438-443 (2005) (Abstract Only).

Morgan, et al. "Cancer regression in patients after transfer of genetically engineered lymphocytes", *Science*, 314(5796):126-129 (2006). Epub Aug. 31, 2006.

Moura, et al. "Alterations on peripheral blood B-cell subpopulations in very early arthritis patients", Rheumatology (Oxford), 49(6):1082-1092 (2010). doi: 10.1093/rheumatology/keq029. Epub Mar. 7, 2010.

Murugan, et al. "Statistical inference of the generation probability of T-cell receptors from sequence repertoires", PNAS, 109(40):16161-16166 (2012). doi: 10.1073/pnas.1212755109. Epub Sep. 17, 2012.

Nakano, et al. "Single-molecule PCR using water-in-oil emulsion", J Biotechnol., 102(2):117-124, Abstract Only (2003).

Navarrete, et al. "Upfront immunization with autologous recombinant idiotype Fab fragment without prior cytoreduction in indolent B-cell lymphoma", Blood, 117(5):1483-1491 (2011). doi: 10.1182/blood-2010-06-292342. Epub Nov. 2, 2010.

Nielsen, et al. "Peptide nucleic acid (PNA). A DNA mimic with a pseudopeptide backbone", Chem. Soc. Rev., 26:73-78, Abstract Only (1997).

Oelke, et al. "Ex vivo induction and expansion of antigen-specific cytotoxic T cells by HLA-Ig-coated artificial antigen-presenting cells", Nat Med., 9(5):619-624 (2003). Epub Apr. 21, 2003.

Ottensmeier, et al. "Analysis of $V_H$ genes in follicular and diffuse lymphoma shows ongoing somatic mutation and multiple isotype transcripts in early disease with changes during disease progression", Blood, 91(11):4292-4299 (1998).

Palmowski, et al. "The use of HLA class I tetramers to design a vaccination strategy for melanoma patients", *Immunol Rev.*, 188:155-163 (2002) (Abstract Only).

Palomaki, et al. "DNA sequencing of maternal plasma reliably identifies trisomy 18 and trisomy 13 as well as Down syndrome: an international collaborative study", *Genet Med.*, 14(3):296-305 (2012). doi: 10.1038/gim.2011.73. Epub Feb. 2, 2012.

Parmigiani, et al. "Design and analysis issues in genome-wide somatic mutation studies of cancer", Genomics, 93(1):17-21 (2009). doi: 10.1016/j.ygeno.2008.07.005. Epub Aug. 23, 2008.

Peet. "The Measurement of Species Diversity", Annual Review of Ecology and Systematics, 5:285-307, Abstract Only (1974).

Petrosino, et al. "Metagenomic pyrosequencing and microbial identification", Clin Chem., 55(5):856-866 (2009). doi: 10.1373/clinchem.2008.107565. Epub Mar. 5, 2009.

PCT/US2009/006053, Written Opinion dated Jun. 15, 2010, 4 pages.
PCT/US2009/006053, International Preliminary Report on Patentability dated May 10, 2011, 5 pages.
PCT/US2011/000791, International Preliminary Report on Patentability dated Nov. 6, 2012, 10 pages.
PCT/US2011/000792, International Preliminary Report on Patentability dated Nov. 6, 2012, 8 pages.
PCT/US2012/053530, International Search Report and Written Opinion dated Feb. 26, 2013, 13 pages.
PCT/US2012/053530, International Preliminary Report on Patentability dated Mar. 12, 2014, 7 pages.
PCT/US2012/058989, International Search Report and Written Opinion dated Mar. 29, 2013, 12 pages.
PCT/US2012/058989, International Preliminary Report on Patentability dated Apr. 15, 2014, 8 pages.
PCT/US2012/061977, International Search Report and Written Opinion dated Feb. 25, 2013, 11 pages.
PCT/US2012/061977, International Preliminary Report on Patentability dated May 6, 2014, 7 pages.
PCT/US2012/067656, International Search Report and Written Opinion dated Mar. 13, 2013, 6 pages.
PCT/US2012/067656, International Preliminary Report on Patentability dated Jun. 10, 2014, 4 pages.
PCT/US2012/068631, International Search Report and Written Opinion dated Feb. 26, 2013, 8 pages.
PCT/US2012/068631, International Preliminary Report on Patentability dated Jun. 10, 2014, 7 pages.
PCT/US2012/069187, International Search Report and Written Opinion dated Feb. 22, 2013, 8 pages.
PCT/US2012/069187, International Preliminary Report on Patentability dated May 5, 2015, 6 pages.
PCT/US2012/069310, International Preliminary Report on Patentability dated Jun. 17, 2014, 6 pages.
PCT/US2012/070674, International Search Report and Written Opinion dated Feb. 22, 2013, 8 pages.
PCT/US2012/070674, International Preliminary Report on Patentability dated Aug. 5, 2014, 6 pages.
PCT/US2013/028942, International Search Report and Written Opinion dated May 9, 2013, 10 pages.
PCT/US2013/028942, International Preliminary Report on Patentability dated May 5, 2015, 9 pages.
PCT/US2013/029181, International Search Report and Written Opinion dated May 31, 2013, 6 pages.
PCT/US2013/029181, International Preliminary Report on Patentability dated Sep. 9, 2014, 5 pages.
PCT/US2013/035857, International Search Report and Written Opinion dated Aug. 7, 2013, 10 pages.
PCT/US2013/035857, International Preliminary Report on Patentability dated Oct. 14, 2014, 8 pages.
PCT/US2013/045276, International Search Report and Written Opinion dated Jan. 29, 2014, 11 pages.
PCT/US2013/045276, International Preliminary Report on Patentability dated Dec. 16, 2014, 7 pages.
PCT/US2013/051539, International Search Report and Written Opinion dated Nov. 27, 2013, 9 pages.
PCT/US2013/051539, International Preliminary Report on Patentability dated Jan. 27, 2015, 7 pages.
PCT/US2013/065493, International Search Report and Written Opinion dated Jan. 20, 2014, 14 pages.
PCT/US2013/065493, International Preliminary Report on Patentability dated Apr. 21, 2015, 10 pages.
PCT/US2013/065757, International Search Report and Written Opinion dated Jan. 21, 2014, 10 pages.
PCT/US2013/065757, International Preliminary Report on Patentability dated Apr. 28, 2015, 6 pages.
PCT/US2014/017416, International Search Report dated May 12, 2014, 9 pages.
PCT/US2014/047909, International Search Report dated Nov. 17, 2014.

Polstra, et al. "Development of real-time NASBA assays with molecular beacon detection to quantify mRNA coding for HHV-8 lytic and latent genes", BMC Infect Dis., 2:18 (2002). Epub Sep. 4, 2002.

Pourmand, et al. "Direct electrical detection of DNA synthesis", PNAS, 103(17):6466-6470 (2006). Epub Apr. 13, 2006.

Ramsden, et al. "V(D)J recombination: Born to be wild", Semin Cancer Biol., 20(4):254-260 (2010). doi: 10.1016/j.semcancer.2010.06.002. Epub Jul. 1, 2010.

Reddy, et al. "Monoclonal antibodies isolated without screening by analyzing the variable-gene repertoire of plasma cells", *Nat Biotechnol.*, 28(9):965-969 (2010) (Abstract Only). doi: 10.1038/nbt.1673. Epub Aug. 29, 2010.

Ronaghi, et al. "A sequencing method based on real-time pyrophosphate", Science, 281(5375):363, 365, 5 pages (1998).

(56) References Cited

OTHER PUBLICATIONS

Rothberg, et al. "An integrated semiconductor device enabling non-optical genome sequencing", *Nature*, 475(7356):348-352 (2011). doi: 10.1038/nature10242.
Sebastian, E. et al., "Molecular Characterization of immunoglobulin gene rearrangements in diffuse large B-cell lymphoma", Am. J. Pathol., 181:1879-1888, Abstract (2012). (Epub: Sep. 28, 2012).
Seitz, et al. "Reconstitution of paired T cell receptor α- and β-chains from microdissected single cells of human inflammatory tissues", *PNAS*, 103:12057-12062 (2006).
Seo, et al. "Four-color DNA sequencing by synthesis on a chip using photocleavable fluorescent nucleotides", PNAS, 102(17):5926-5931 (2005). Epub Apr. 13, 2005.
SG Application No. 11201403212R, Written Opinion mailed Mar. 27, 2015, 12 pages.
Shendure, et al. "Accurate multiplex polony sequencing of an evolved bacterial genome", *Science*, 309(5741):1728-1732, Abstract Only (2005). Epub Aug. 4, 2005.
Shumaker, et al. "Mutation detection by solid phase primer extension", Hum Mutat., 7(4):346-354, Abstract Only (1996).
Sia, et al. "Microfluidic devices fabricated in poly(dimethylsiloxane) for biological studies", Electrophoresis, 24(21):3563-3576, Abstract Only (2003).
Sims, et al. "Fluorogenic DNA sequencing in PDMS microreactors", *Nat Methods*, 8(7):575-580 (2011). doi: 10.1038/nmeth.1629.
Sims, et al. "MHC-peptide tetramers for the analysis of antigen-specific T cells", Expert Rev Vaccines, 9(7):765-774 (2010). doi: 10.1586/erv.10.66.
Sobrino, et al. "SNPs in forensic genetics: a review on SNP typing methodologies", Forensic Sci Int., 154(2-3):181-194, Abstract Only (2005). Epub Jan. 11, 2005.
Steenbergen, et al. "Frequent ongoing T-cell receptor rearrangements in childhood B-precursor acute lymphoblastic leukemia: implications for monitoring minimal residual disease", Blood, 86(2):692-702, Abstract Only (1995).
Stemmer, et al. "Single-step assembly of a gene and entire plasmid from large numbers of oligodeoxyribonucleotides", Gene, 164(1):49-53 (1995).
Stickler, et al. "An in vitro human cell-based assay to rank the relative immunogenicity of proteins", Toxicol Sci., 77(2):280-289 (2004). Epub Dec. 22, 2003.
Stratton. "Exploring the genomes of cancer cells: progress and promise", Science, 331(6024):1553-1558 (2011). doi: 10.1126/science.1204040.
Takamatsu, et al., "A comparison between next-generation sequencing and A SO-qP CR for minimal residual disease detection in multiple myeloma", J. Clin. Oncol., 31(Supplement 1): Abstract 8601 (Conference Abstract), Entire Abstract (2013).
Tautz, et al. "Cryptic simplicity in DNA is a major source of genetic variation", Nature, 322(6080):652-656 (1986).
Tawfik, et al. "Man-made cell-like compartments for molecular evolution", Nat Biotechnol., 16(7):652-656, Abstract Only (1998).
Thor Straten, et al. "T-cell clonotypes in cancer", J Transl Med., 2(1):11, 10 pages (2004).
Tschumper, et al. "Comprehensive assessment of potential multiple myeloma immunoglobulin heavy chain V-D-J intraclonal variation using massively parallel pyrosequencing", Oncotarget, 3(4):502-513 (2012).
Turcotte and Rosenberg. "Immunotherapy for metastatic solid cancers", *Adv Surg.*, 45:341-360 (2011).
Urban, et al. "A systematic and quantitative analysis of PCR template contamination", J Forensic Sci., 45(6):1307-1311 (2000).
Urquhart, et al. "Rate-controlled delivery systems in drug and hormone research", Annu Rev Pharmacol Toxicol., 24:199-236, Abstract Only (1984).
Venturi, et al. "A mechanism for TCR sharing between T cell subsets and individuals revealed by pyrosequencing", J Immunol., 186(7):4285-4294 (2011). doi: 10.4049/jimmunol.1003898. Epub Mar. 7, 2011.

Vester, et al. "LNA (locked nucleic acid): high-affinity targeting of complementary RNA and DNA", Biochemistry, 43(42):13233-13241, Abstract Only (2004).
Vogelstein et al. "Cancer genome landscapes", Science, 339(6127):1546-58 (2013). doi: 10.1126/science.1235122.
Wälchli, et al. "A practical approach to T-cell receptor cloning and expression", *PLoS One*, 6(11):e27930, 11 pages (2011). doi: 10.1371/journal.pone.0027930. Epub Nov. 21, 2011.
Welch and Link. "Genomics of AML: clinical applications of next-generation sequencing", *American Society of Hematology*, 2011:30-35 (2011). doi: 10.1182/asheducation-2011.1.30.
Wells, et al. "Rapid evolution of peptide and protein binding properties in vitro", Curr Opin Biotechnol., 3(4):355-362, Abstract Only (1992).
Weusten, et al. "Principles of quantitation of viral loads ing nucleic acid sequence-based amplification in combination with homogeneo detection ing molecular beacons", Nucleic Acids Res., 30(6):e26, 7 pages (2002).
Whiteford, et al. "Swift: primary data analysis for the Illumine Solexa sequencing platform", *Bioinformatics*, 25(17):2194-2199 (2009). doi: 10.1093/bioinformatics/btp383. Epub Jun. 23, 2009.
Williams, et al. "Amplification of complex gene libraries by emulsion PCR", Nat Methods, 3(7):545-550 (2006).
Wolda. "Similarity Indices, Sample Size and Diversity", Oecologia (Berl), 50:296-302 (1981).
Wolfl, et al. "Activation-induced expression of CD137 permits detection, isolation, and expansion of the full repertoire of CD8+ T cells responding to antigen without requiring knowledge of epitope specificities", Blood, 110(1):201-210 (2007). Epub Mar. 19, 2007.
Wolfl, et al. "Use of CD137 to study the full repertoire of CD8+ T cells without the need to know epitope specificities", Cytometry A., 73(11):1043-1049 (2008). doi: 10.1002/cyto.a.20594.
Xiong, et al. "Chemical gene synthesis: strategies, softwares, error corrections, and applications", FEMS Microbiol Rev., 32(3):522-540 (2008). doi: 10.1111/j.1574-6976.2008.00109.x. Epub Apr. 2, 2008.
Xiong, et al. "Non-polymerase-cycling-assembly-based chemical gene synthesis: strategies, methods, and progress", Biotechnol Adv., 26(2):121-134, Abstract Only (2008). Epub Nov. 7, 2007.
Yao, et al. "Analysis of the CDR3 length repertoire and the diversity of TCRα chain in human peripheral blood T Lymphocyts", *Cell Mol Immunol.*, 4(3):215-220 (2007).
Yeh, et al. "Regulating DNA translocation through functionalized soft nanopores", Nanoscale, 4(8):2685-4693, Abstract Only (2012). doi: 10.1039/c2nr30102d. Epub Mar. 15, 2012.
York, et al. "Highly parallel oligonucleotide purification and functionalization using reversible chemistry", *Nucleic Acids Res.*, 40(1):e4, 7 pages (2012). doi: 10.1093/nar/gkr910. Epub Oct. 29, 2011.
Zagnoni, et al. "Droplet Microfluidics for High-throughput Analysis of Cells and Particles", Methods in Cell Biology, Chapter 2, 102:23-48 (2011).
Brisco, et al. "Outcome prediction in childhood acute lymphoblastic leukaemia by molecular quantification of residual disease at the end of induction", *Lancet*, 343:196-200 (1994).
EP Application No. 12841014.9, Extended European Search Report dated May 4, 2015, 11 pages.
PCT/US2013/062925, International Preliminary Report on Patentability mailed Apr. 16, 2015, 30 pages.
Akatsuka, Y. et al., "Rapid screening of T-cell receptor (TCR) variable gene usage by multiplex PCR: Application for assessment of clonal composition", *Tissue Antigens*, 53:122-134 (1999).
Al-Lazikani, B. et al., "Standard Conformations for the Canonical Structures of Immunoglobulins," *J. Mol. Biol.*, 273:927-948 (1997).
Alexandre, D. et al. "*H. sapiens* rearranged T-cell receptor gamma chain gene, V2-JP1", GenBank accession No. X57737, NCBI, Nov. 14, 2006, 8 pages [online] [retrieved on Jun. 26, 2013] Retrieved from the internet <URL:http://www.ncbi.nlm.nih.gov/nuccore/x57737>.
Alexandre, D. et al. "*H. sapiens* rearranged T-cell receptor gamma chain gene, V3RS-J1 (hybrid joint)", GenBank accession No. X57740, NCBI, Feb. 11, 1997, 8 pages [online] [retrieved on Jun. 26, 2013] Retrieved from the internet <URL:http://www.ncbi.nlm.nih.gov/nuccore/x57740>.

(56) References Cited

OTHER PUBLICATIONS

Arstila, T.P., et al., "A direct estimate of the human αβ T cell receptor diversity," *Science*, 286(5441):958-961 (1999).
Bahloul, M. et al., "Clinical impact of molecular diagnostics in low-grade lymphoma," *Best Practice & Research Clinical Haematology*, 18(1):97-111 (2005).
Benichou, J. et al., "Rep-Seq: uncovering the immunological repertoire through next-generation sequencing", *Immunology*, 135(3):183-191 (2012).
Bernardin, F. et al., "Estimate of the total number of CD8+ clonal expansions in healthy adults using a new DNA heteroduplex-tracking assay for CDR3 repertoire analysis", *Journal of Immunological Methods*, 274(I-2):159-175 (2003).
Berquam-Vrieze, K. et al., "Cell of origin strongly influences genetic selection in a mouse model of T-ALL", *Blood*, 118:4646-4656 (2011).
Blow, N., "PCR's next frontier," *Nature Methods*, 4(10):869-875 (2007).
Bolotin, D.A. et al., "Next generation sequencing for TCR repertoire profiling: Platform-specific features and correction algorithms", *Eur. J. Immunol.*, 42:3073-3083 (2012).
Bonarius, H.P.J. et al., "Monitoring the T-Cell Receptor Repertoire at Single-Clone Resolution", *PLOS One*, 1(e55):1-10 (2006).
Boyd, S.D. et al., Individual Variation in the Germline Ig Gene Repertoire Inferred from Variable Region Gene Rearrangements, *The Journal of Immunology*, 184(12):6986-6992 (2010).
Boyd, S.D. et al., "Measurement and Clinical Monitoring of Human Lymphocyte Clonality by Massively Parallel V-D-J Pyrosequencing," *Science Translational Medicine*, 1:12ra23, 40 pages, Supplementary Materials (2009).
Bradfield, S.M. et al., "Graft-versus-leukemia effect in acute lymphoblastic leukemia: the importance of tumor burden and early detection," *Leukemia*,18:1156-1158 (2004).
Brenan, C. et al., "High throughput, nanoliter quantitative PCR," *Drug Discovery Today: Technologies*, 2(3):247-253 (2005).
Buck, G.A. et al., "Design Strategies and Performance of Custom DNA Sequencing Primers", *Biotechniques*, 27(3):528-536 (1999).
Butkus, B., "Hutch Team Uses ddPCR to Quantify T-Cell Response in Tumors; Adaptive Biotech Eyes Market", PCR Insider, Dec. 12, 2013, 3 pages http://www.genomeweb.com/print/1323296.
Campana, D., "Progress of Minimal Residual Disease Studies in Childhood Acute Leukemia," *Curr Hematol Malig Rep*, 5:169-176 (2010).
Caporaso, J.G. et al., "Global patterns of 16S rRNA diversity at a depth of millions of sequences per sample", *PNAS*, 108(Suppl. 1):4516-4522 (2010).
Carlson, C.S. et al., "Using synthetic templates to design an unbiased multiplex PCR assay", *Nature Communications*, 4:2680, pp. 1-9 (2013).
Cavé, H. et al., "Clinical Significance of minimal residual disease in childhood acute lymphoblastic leukemia," *The New England Journal of Medicine*, 339:591-598 (1998).
Chen, Y. et al., "T-cell receptor gene expression in tumour-infiltrating lymphocytes and peripheral blood lymphocytes of patients with nasopharyngeal carcinoma", *British Journal of Cancer*, 72(1):117-22 (1995).
Chothia, C. et al., "Canonical structures for the hypervariable regions of immunoglobulins," *J. Mol. Biol.*, 196:901-917, Abstract only (1987).
Chothia, C. et al., "Conformations of immunoglobulin hypervariable regions," *Nature*, 342:877-883 (1989).
Ciudad, J. et al., "Detection of abnormalities in B-cell differentiation pattern is a useful tool to predict relapse in precursor-B-ALL," *British Journal of Haematology*, 104:695-705 (1999).
Coustan-Smith, E. et al., "Clinical importance of minimal residual disease in childhood acute lymphoblastic leukemia," *Blood*, 96(8):2691-2696 (2000).
Coustan-Smith, E. et al., "Early T-cell precursor leukaemia: a subtype of very high-risk acute lymphoblastic leukaemia," *Lancet Oncology*, 10:147-156 (2009).
Coustan-Smith, E. et al., "Prognostic importance of measuring early clearance of leukemic cells by flow cytometry in childhood acute lymphoblastic leukemia", *Blood*, 100(1):52-58 (2002).
Curran-Everett, D., "Multiple comparisons: philosophies and illustrations", *Am J Physiol Regulatory Integrative Comp Physiol.*, 279:R1-R8 (2000).
Dash, P. et al., "Paired analysis of TCR[alpha] and TCR[beta] chains at the single-cell level in mice", *Journal of Clinical Investigation*, 121(1):288-295 (2011).
De Jonge, H.J.M., et al., "Evidence Based Selection of Housekeeping Genes," *PLoS One*, 9(e989):1-5 (2007).
DeNucci, C.C. et al., "Integrin function in T-cell homing to lymphoid and nonlymphoid sites: getting there and staying there," *Critical Reviews in Immunology*, 29(2):87-109 (2009).
Dheda, K., et al., "Validation of housekeeping genes for normalizing RNA expression in real-time PCR," *Bio Techniques*, 37:112-119 (2004).
Dik, W., et al. "New insights on human T cell development by quantitative T cell receptor gene rearrangement studies and gene expression profiling," *JEM*, 201(11):1715-1723 (2005).
Dobosy, J. et al., "RNase H-dependent PCR (rhPCR): improved specificity and single nucleotide polymorphism detection using blocked cleavable primers," *BMC Biotechnology*, 11(80):1-18 (2011).
Droese, J., et al., "Validation of BIOMED-2 multiplex PCR tubes for detection of TCRB gene rearrangements in T-cell malignancies," *Leukemia*, 18:1531-1538 (2004).
Duby, A.D. et al., "Human T-cell receptor aberrantly rearranged beta-chain J1.5-Dx-J2.1 gene," *PNAS*, GenBank accession No. M13574.1, bases 1 to 100, 4 pages (1986).
Edwards and Gibbs, "Multiplex PCR: advantages, development, and applications," *Genome Research*, 3:S65-S75 (1994).
Elnifro, E.M., et al., "Multiplex PCR: Optimization and Application in Diagnostic Virology", *Clinical Microbiology Reviews*, 13(4):559-570 (2000).
Emerson, R.O. et al., "High-throughput sequencing of T-cell receptors reveals a homogeneous repertoire of tumour-infiltrating lymphocytes in ovarian cancer", *Journal of Pathology*, 231:433-440 (2013).
Faham, M. et al., "Deep-sequencing approach for minimal residual disease detection in acute lymphoblastic leukemia", *Blood*, 120(26):5173-5180 (2012).
Flohr, T., et al., "Minimal residual disease-directed risk stratification using real-time quantitative PCT analysis of immunoglobulin and T-cell receptor gene rearrangements in the international multicenter trial AIEOP-BFM ALL 2000 for childhood acute lymphoblastic leukemia", *Leukemia*, 22:771-782 (2008).
Freeman, J.D., et al., "Profiling the T-Cell Receptor Beta-Chain Repertoire by Massively Parallel Sequencing", *Genome Research*, 19(10):1817-1824 (2009).
Gerlinger, M. et al., "Ultra deep T cell receptor sequencing reveals the complexity and intratumour heterogeneity of T cell clones in renal cell carcinomas", *Journal of Pathology*, 231:424-432 (2013).
Gonzalez, S.F., et al., "Trafficking of B Cell Antigen in Lymph Nodes," *Ann. Rev. Immunol.*, 29:215-233 (2011).
Henegariu O. et al., "Multiplex PCR: Critical Parameters and Step-by-Step Protocol", *Biotechniques*, Informa HealthCare, 23(3):504-511 (1997).
Hodges, E. et al., "Diagnostic role of tests for T cell receptor (TCR) genes", *J Clin Pathol.*, 56(1):1-11 (2003).
Hwang, H.Y. et al., "Identification of a Commonly used CDR3 Region of Infiltrating T Cells Expressing Vβ13 and Vβ15 Derived from Psoriasis Patients", *The Journal of Investigative Dermatology*, 120(3):359-364 (2003).
Jochems and Schlom, "Tumor-infiltrating immune cells and prognosis: the potential link between conventional cancer therapy and immunity," *Experimental Biology and Medicine*, 236:567-579 (2011).
Kalinina, O. et al., "Nanoliter scale PCR with TaqMan detection," *Nucleic Acids Research*, 25(10):1999-2004 (1997).
Kalos, M. et al., "T Cells with Chimeric Antigen Receptors Have Potent Antitumor Effects and Can Establish Memory in Patients with Advanced Leukemia", *Science Translational Medicine*, 3(95ra73):1-11 (2011).

(56) References Cited

OTHER PUBLICATIONS

Kaplinski and Remm, "MultiPLX Automatic Grouping and Evaluation of PCR Primers", *Methods in Molecular Biology*, 402(PCR Primer Design):287-303 (2004).
Klarenbeek, P.L. et al., "Human T-cell memory consists mainly of unexpanded clones", *Immunology Letters*, 133:42-48 (2010).
Katz, S.C. et al., "T Cell Infiltrate Predicts Long-Term Survival Following Resection of Colorectal Cancer Liver Metastases," *Ann. Surg. Oncol.*, 16:2524-2530 (2009).
Kehrl, J.H. et al., "Chemoattractant Receptor Signaling and Its Role in Lymphocyte Motility and Trafficking," *Current Topics in Microbiology and Immunology*, 334:107-127 (2009).
Kiianitsa, et al., "Development of Tools for T-Cell Repertoire Analysis (TCRB Spectratyping) for the Canine Model of Hematopoietic Cell Transplantation", *Blood*, ASH—Annual Meeting Abstracts, 110:Abstract 4873, 2 pages (2007).
Kneba, M., et al., "Analysis of Rearranged T-cell Receptor β-Chain Genes by Polymerase Chain Reaction (PCR) DNA Sequencing and Automated High Resolution PCR Fragment Analysis", *Blood*, 86:3930-3937 (1995).
Ladányi, A., et al., "Prognostic impact of B-cell density in cutaneous melanoma", *Cancer Immunol. Immunother*, 60(12):1729-1738 (2011).
Larimore K. et al., "Shaping of Human Germline IgH Repertoires Revealed by Deep Sequencing", The *Journal of Immunology*, 189(6):3221-3230 (2012).
Ladetto, M. et al., "Real-Time Polymerase Chain Reaction of Immunoglobulin Rearrangements for Quantitative Evaluation of Minimal Residual Disease in Multiple Myeloma", *American Society for Blood and Marrow Transplantation*, 6(3):241-253 (2000).
Ladetto, M. et al., "Real-time polymerase chain reaction in multiple myeloma: Quantitative analysis of tumor contamination of stem cell harvests", *Experimental Hematology*, 30:529-536 (2002).
Logan, A.C. et al., "High-throughput VDJ sequencing for quantification of minimal residual disease in chronic lymphocytic leukemia and immune reconstitution assessment", *PNAS*, 108(52):21194-21199 (2011).
Lowe, T., et al., "A computer program for selection of oligonucleotide primers for polymerase chain reactions," *Nucleic Acids Research*, 18(7):1757-1761 (1990).
Lúcio, P. et al., "Flow cytometric analysis of normal B cell differentiation: a frame of reference for the detection of minimal residual disease in precursor-B-ALL", *Leukemia*, 13:419-427 (1999).
Mahmoud, S.M.A. et al., "Tumor-Infiltrating CD8+ Lymphocytes Predict Clinical Outcome in Breast Cancer", *Journal of Clinical Oncology*, 29(15):1949-1955 (2011).
Marelli-Berg, F.M., et al., "Memory T-cell trafficking: new directions for busy commuters," *Immunology*, 130:158-165 (2010).
Mariani, S. et al., "Comprehensive assessment of the TCRBV repertoire in small T-cell samples by means of an improved and convenient multiplex PCR method," *Experimental Hematology*, 37(6):728-738 (2009).
Markoulatos, P. et al., "Multiplex Polymerase Chain Reaction: A Practical Approach", *Journal of Clinical Laboratory Analysis*, 16:47-51 (2002).
Maryanski, J.L. et al., "A quantitative, single-cell PCR analysis of an antigen-specific TCR repertoire 8 selected during an in vivo CD8 response: direct evidence for a wide range of clone sizes with uniform tissue distribution", *Molecular Immunology*, 36:745-753 (1999).
Maślanka, K. et al., "Molecular Analysis of T-Cell Repertoires: Spectratypes Generated by Multiplex Polymerase Chain Reaction and Evaluated by Radioactivity or Fluorescence", *Human Technology*, 44(1):28-34 (1995).
Merriam-Webster, 4 pages (definition of "substantial," accessed Apr. 25, 2014).
Merriam-Webster, 2 pages, (definition of "e.g.," accessed Apr. 25, 2014).
Miqueu, P. et al., "Statistical analysis of CDR3 length distributions for the assessment of T and B cell repertoire biases," *Molecular Immunology*, 44:1057-1064 (2007).
Monod, M.Y. et al., "IMGT/JunctionAnalysis: the first tool for the analysis of the immunogloblulin and T cell receptor complex V-J and V-D-J JUNCTIONs", *Bioinformatics*, 20(Suppl 1):i379-385 (2004).
Slightom, J.L. et al., "*Homo sapiens* germline beta T-cell receptor locus," NCBI Accession No. L36092 NCBI, 254 pages (2009) Retrieved from the Internet: <URL:http://www.ncbi.nlm.nih.gov/nuccore/L36092>.
Nicot, N. et al., "Housekeeping gene selection for real-time RT-PCR normalization in potato during biotic and abiotic stress," *Journal of Experimental Botany*, 56(421):2907-2914 (2005).
Nolan, T. et al., "Quantification of mRNA using real-time RT-PCR," *Nature Protocols*, 1(3):1559-1582 (2006).
PCT International Search Report and Written Opinion, PCT/US2010/021264, mailed Apr. 14, 2010, 7 pages.
PCT International Preliminary Report on Patentability, PCT/US2010/021264, mailed Jul. 19, 2011, 5 pages.
International Search Report and Written Opinion, PCT/US2013/040221, dated Sep. 23, 2013, 15 pages.
PCT International Preliminary Report on Patentability, PCT/US2013/040221, dated Apr. 24, 2014, 41 pages.
PCT International Search Report and Written Opinion, PCT/US2010/037477, mailed Sep. 24, 2010, 10 pages.
PCT International Preliminary Report on Patentability, PCT/US2010/037477, dated Jan. 4, 2012, 7 pages.
PCT International Search Report and Written Opinion, PCT/US2012/061193, mailed Mar. 28, 2013, 13 pages.
PCT International Preliminary Report on Patentability, PCT/US2012/061193, mailed Apr. 22, 2014, 8 pages.
PCT International Search Report and Written Opinion, PCT/US2012/068617, mailed Mar. 28, 2013, 10 pages.
PCT International Preliminary Report on Patentability, PCT/US2012/068617, mailed Jun. 10, 2014, 6 pages.
PCT International Search Report and Written Opinion, PCT/US2013/062925, mailed Nov. 25, 2013, 12 pages.
PCT Second Written Opinion for PCT/US2013/062925 mailed Jan. 23, 2015, 7 pages.
PCT International Search Report and Written Opinion, PCT/US2011/049012, mailed Apr. 10, 2012, 9 pages.
PCT International Preliminary Report on Patentability, PCT/US2011/049012, dated Feb. 26, 2013, 5 pages.
PCT International Search Report and Written Opinion, PCT/US2013/045994, mailed Oct. 25, 2013, 15 pages.
PCT International Preliminary Report on Patentability, PCT/US2013/045994, dated Dec. 16, 2014, 10 pages.
PCT International Search Report and Written Opinion, PCT/US2011/026373, mailed Oct. 20, 2011, 17 pages.
PCT International Preliminary Report on Patentability, PCT/US2011/026373, dated Aug. 28, 2012, 11 pages.
PCT International Search Report and Written Opinion, PCT/US2014/030859, mailed Jul. 18, 2014, 7 pages.
Pekin, D. et al., "Quantitative and sensitive detection of rare mutations using droplet-based microfluidics", *Lab Chip*, 11(3):2156 (2011).
Perkel, J., "Overcoming the Challenges of Multiplex PCR," *Biocompare Editorial Article*, Oct. 23, 2012, 6 Pages, can be retrieved at URL:http://www.biocompare.com/Editorial-Articles/117895-Multiplex-PCR/>.
Pohl, G. and Shih, "Principle and applications of digital PCR," *Expert Rev. Mol. Diagn.*, 4(1):41-47 (2004).
Puisieux, I. et al., "Oligoclonality of Tumor-Infiltrating Lymphocytes from Human Melanomas," *The Journal of Immunology*, 153:2807-2818 (1994).
Rasmussen, T. et al., Quantitation of minimal residual disease in multiple myeloma using an allele-specific real-time PCR assay, *Experimental Hematology*, 28:1039-1045 (2000).
Reischl and Kochanowski, et al., "Quantitative PCR a Survey of the Present Technology," *Molecular Biotechnology*, 3:55-71 (1995).
Robins H.S. et al., "Comprehensive assessment of T-cell receptor β-chain diversity in αβ T cells", *Blood*, 114(19):4099-4107 (2009).
Robins, H.S. et al., "Digital Genomic Quantification of Tumor Infiltrating Lymphocytes", *Science Translational Medicine*, 5:214ra169, 19 pages, Supplementary Materials (2013).

(56) References Cited

OTHER PUBLICATIONS

Robins, H. et al., "Detecting and monitoring lymphoma with high-throughput sequencing", *Oncotarget*, 2:287-288 (2011).
Robins, H. et al., "Overlap and Effective Size of the Human CD8+ T Cell Receptor Repertoire", *Science Transitional Medicine*, 2(47, 47ra64):17 pages, Supplemental Materials (2010).
Robins, H. et al., "The Computational Detection of Functional Nucleotide Sequence Motifs in the Coding Regions of Organisms", *Exp Bioi Med*, 233(6):665-73 (2008).
Robins, H., et al., "Ultra-sensitive detection of rare T cell clones", *Journal of Immunological Methods*, 375:14-19 (2012).
Rock, E.P. et al., "CDR3 Length in Antigen-specific Immune Receptors", *J. Exp. Med.*, 179:323-328 (1994).
Rosenberg, S.A. et al., "New Approach to the Adoptive Immunotherapy of Cancer with Tumor-Infiltrating Lymphocytes", *Science*, 233(4770):1318-1321 (1986).
Roshal, M. et al., "Immaturity Associated Antigens Are Lost During Induction for T Cell Lymphoblastic Leukemia: Implications for Minimal Residual Disease Detection", *Cytometry Part B* (Clinical Cytometry), 78:139-146 (2010).
Rozen, S., et al., "Primer3 on the WWW for General Users and for Biologist Programmers," *Methods in Molecular Biology*, Bioinformatics Methods and Protocols, 132:365-386 (2000).
Saada, R. et al., "Models for antigen receptor gene rearrangement: CDR3 length", *Immunology and Cell Biology*, 85:323-332 (2007).
Santalucia, Jr., J., "Physical Principles and Visual-OMP Software for Optimal PCR Design," *Methods in Molecular Biology*, 402(PCR Primer Design):3-33, 40 pages (2007).
Santamaria, P. et al., "Beta-Cell-Cytotoxic CDS T Cells from Nonobese Diabetic Mice Use Highly Homologous T Cell Receptor a-Chain CDR3 Sequences", *The Journal of Immunology*, 154(5):2494-2503 (1995).
Schlissel, M.S. et al., "Leukemia and lymphoma: a cost of doing business for adaptive immunity", *Genes Dev.*, 20(12):1539-44 (2006).
Schrappe, M. et al., "Late MRD response determines relapse risk overall and in subsets of childhood T-cell ALL: results of the AIEOP-BFM-ALL 2000 study", *Blood*, 118(8):2077-2084 (2011).
Sherwood, A., et al., "Deep Sequencing of the Human TCRγ and TCRβ Repertoires Suggests that TCR β Rearranges After αβ and γδ T Cell Commitment," *Science Translational Medicine*, 3(90):1-7 (2011).
Silver, N. et al., "Selection of housekeeping genes for gene expression studies in human reticulocytes using real-time PCR", *BMC Molecular Biology*, 7(33):1-9 (2006).
Sint, D., et al., "Advances in Multiplex PCR: balancing primer efficiencies and improving detection success", *Methods in Ecology and Evolution*, 3(5):898-905 (2012).
Standard Sequencing Primers, Max Planck Genome Center Cologne, Jan. 15, 2011, downloaded from https://genomecentre.mpipz.mpg.de/SeqOrderDB/export/sequencing-primers.html.
Stein and Nombela-Arrieta, "Chemokine control of lymphocyte trafficking: a general overview," *Immunology*, 116(10):1-12 (2005).
Steinmetz, O.M. et al., "Chemokines and B cells in renal inflammation and allograft rejection," *Frontiers in Bioscience* (Schol. Ed.), 1:13-22 (2009).
Straten, Per thor, et al., "T-cell clonotypes in cancer", *Journal of Translational Medicine*, 2(1):11 (2004).
Supplementary European Search Report for European Application No. 10732172.1, dated May 29, 2012, 5 pages.
Szczepanski, T. et al., "Minimal residual disease in leukemia patients", *Lancet Oncology*, 2:409-417 (2001).
Tewhey, R. et al., "Corrigendum: Microdroplet-based PCR enrichment for large-scale targeted sequencing", *Nature Biotechnology*, 28(2):178, 1 page (2010).
Tewhey, R. et al., "Microdroplet-based PCR enrichment for large-scale targeted sequencing," *Nature Biotechnology*, 27(11):1025-1031 (2009).

Triebel, F. et al., "A Unique V-J-C-Rearranged Gene Encodes A γ Protein Expressed on the Majority of CD3+ T Cell Receptor-a/fr Circulating Lymphocytes", *J. Exp. Med.*, 167:694-699 (1988).
Van Der Velden, VHJ et al., "Analysis of minimal residual disease by Ig/TCR gene rearrangements: guidelines for interpretation of real-time quantitative PCR data," *Leukemia*, 21:604-611 (2007).
Van Der Velden, VHJ et al., "Optimization of PCR-based minimal residual disease diagnostics for childhood acute lymphoblastic leukemia in a multi-center setting," *Leukemia*, 21:706-713 (2007).
Van Der Velden, V.H.J., et al., "Detection of minimal residual disease in hematologic malignancies by realtime quantitative PCR: principles, approaches, and laboratory aspects," *Leukemia*, 17:1013-1034 (2003).
Van Der Velden, V.H.J., et al., "Real-time quantitative PCR for detection of minimal residual disease before allogeneic stem cell transplantation predicts outcome in children with acute lymphoblastic leukemia", *Leukemia*, 15:1485-1487 (2001).
Van Dongen, J.J.M. et al., "Design and standardization of PCR primers and protocols for detection of clonal immunoglobulin and I-cell receptor gene recombinations in suspect lymphoproliferations: Report of the BIOMED-2 Concerted Action BMHC-CT98-3936", *Leukemia*, 17:2257-2317 (2003).
Van Dongen, J.J.M. et al., "Prognostic value of minimal residual disease in acute lymphoblastic leukaemia in childhood," *The Lancet*, 352:1731-1738 (1998).
Venturi, V. et al., "The molecular basis for public T-cell responses?" *Nature Reviews*, 8:231-238 (2008).
Venturi, V. et al., "TCR β-Chain Sharing in Human CD8+ T Cell Responses to Cytomegalovirus and EBV[1]", *The Journal of Immunology*, 181:7853-7862 (2008).
Verhagen, O.J.H.M., et al., "Application of germline IGH probes in real-time quantitative PCR for the detection of minimal residual disease in acute lymphoblastic leukaemia," *Leukemia*, 14:1426-1435 (2000).
Volgelstein and Kinzler, "Digital PCR," *Genetics, PNAS*, 96:9236-9241 (1999).
Wang, X. et al., "Quantitative Measurement of Pathogen Specific Human Memory T Cell Repertoire Diversity using a CDR3 B-Specific Microarray", *BMC Genomics*, 8(329): 1-13 (2007).
Ward and Marelli-Berg, "Mechanisms of chemokine and antigen-dependent T-lymphocyte navigation," *Biochem. J.*, 418:13-27 (2009).
Weinstein, J.A. et al., "High-Throughput Sequencing of the Zebrafish Antibody Repertoire", *Science*, 324:807-810 (2009).
Wood, B., "9-Color and 10-Color Flow Cytometry in the Clinical Laboratory," *Arch Pathol Lab Med*, 130:680-690 (2006).
Wu, H.D. et al., "The Lymphocytic Infiltration in Calcific Aortic Stenosis Predominantly Consists of Clonally Expanded T Cells", *The Journal of Immunology*, 178(8):5329-5339 (2007).
Wu, Y-C. et al., "High-throughput immunoglobulin repertoire analysis distinguishes between human IgM memory and switched memory B-cell populations", *Blood Journal*, 116(7):1070-1078, 22 pages (2010).
Xu, W. et al., "A Novel Universal Primer-Multiplex-PCR Method with Sequencing Gel Electrophoresis Analysis," *PLoS One*, 7(1):e22900, pp. 1-10 (2012).
Yassai, M.B. et al., "A clonotype nomenclature for T cell receptors", *Immunogenetics*, 61:493-502 (2009).
Zhong, Q. et al., "Multiplex digital PCR: breaking the one target per color barrier of quantitative PCR", *Lab Chip*, 11:2167-2174 (2011).
Alatrakchi et al. "T-cell clonal expansion in patients with B-cell lymphoproliferative disorders", *Journal of Immunotherapy*, 21(5):363-370 (1998).
Altman, et al. "Phenotypic analysis of antigen-specific T lymphocytes", *The Journal of Immunology*, 187(1):7-9 (2011).
Andreasson, et al. The human IgE-encoding transcriptome to assess antibody repertoires and repertoire evolution, *J Mol Biol.*, 362(2):212-27 (2006). Epub Aug. 14, 2006.
Assaf, et al. "High Detection Rate of T-Cell Receptor Beta Chain Rearrangements in T-Cell Lymphoproliferations by Family Specific Polymerase Chain Reaction in Combination with the Genescan Technique and DNA Sequencing", *Blood*, 96(2)640-646 (2000).

(56) References Cited

OTHER PUBLICATIONS

Ateya, et al. "The good, the bad, and the tiny: a review of microflow cytometry", *Anal Bioanal Chem.*, 391(5):1485-98 (2008). doi: 10.1007/s00216-007-1827-5. Epub Jan. 29, 2008.
Babrzadeh et al. "Development on High-throughput Sequencing Technology: emPCR Titration and Barcode Design", Stanford School of Medicine, 2 pages (2011).
Bagnara, et al. "IgV gene intraclonal diversification and clonal evolution in B-cell chronic lymphocytic leukaemia", *British Journal of Haematology*, 133(1):50-58 (2006).
Batzoglou, S. "The many faces of sequence alignment", *Briefings in Bioinformatics*, 6:6-22 (2005).
Becker-André and Hahlbrock. "Absolute mRNA quantification using the polymerase chain reaction (PCR). A novel approach by a PCR aided transcript titration assay (PATTY)", Nucleic Acids Res., 17(22):9437-46 (1989).
Becton-Dickinson, CD marker handbook. bdbiosciences.com/go/mousecdmarkers, pp. 1-47 (2010).
Becton-Dickinson T-Cell Research Tools, "Novel multicolor flow cytometry tools for the study of CD4+ T-cell differentiation and plasticity", 16 pages (2009).
Beishuizen, et al. "Analysis of Ig and T-cell receptor genes in 40 childhood acute lymphoblastic leukemias at diagnosis and subsequent relapse: implications for the detection of minimal residual disease by polymerase chain reaction analysis", *Blood*, 83(8):2238-2247 (1994).
Ben-Ezra, et al. Effect of fixation on the amplification of nucleic acids from paraffin-embedded material by the polymerase chain reaction, *The Journal of Histochemistry and Cytochemistry*, 39(3):351-354 (1991).
Béné and Kaeda, "How and why minimal residual disease studies are necessary in leukemia: a review from WP10 and WP12 of the European LeukaemiaNet", *Haematologica*, 94(8):1135-1150 (2009).
Bentley, et al. "Accurate whole human genome sequencing using reversible terminator chemisry", *Nature*, 456(7218):53-59 (2008). doi: 10.1038/nature07517.
Bereczki, et al. "Optimization of PCR amplification for B- and T-cell clonality analysis on formalin-fixed and paraffin-embedded samples", *Pathology Oncology Research*, 13(3):209-214 (2007). Epub Oct. 7, 2007.
Berget, et al. "Detection of clonality in follicular lymphoma using formalin-fixed, paraffin-embedded tissue samples and BIOMED-2 immunoglobulin primers", *J Clin Pathol.*, 64(1):37-41 (2011). doi: 10.1136/jcp.2010.081109. Epub Oct. 28, 2010.
Bernard et al. "Color multiplexing hybridization probes using the apolipoprotein E locus as a model system for genotyping", *Anal Biochem.*, 273(2):221-228 (1999).
Bertness, et al. "T-Cell Receptor Gene Rearrangements as Clinical Markers of Human T-Cell Lymphomas", *The New England Journal of Medicine*, 313:534-538 (1985).
Biggerstaff, et al. "Enumeration of leukocyte infiltration in solid tumors by confocal laser scanning microscopy", *BMC Immunol.*, 7: 16 (2006).
Bonner et al. "Fluorescence activated cell sorting", *Rev Sci Instrum.*, 43(3):404-409, Abstract Only (1972).
Boria, et al. "Primer sets for cloning the human repertoire of T cell receptor variable regions", *BMC Immunology*, 9:50 (2008).
Boyce, et al. "Human regulatory T-cell isolation and measurement of function", *BD Biosciences*, pp. 1-20 (2010).
Brehm-Stecher and Johnson. "Single-cell microbiology: tools, technologies, and applications", *Microbiology and Molecular Biology Reviews*, 68(3):538-559 (2004).
Brisco, et al. "Determining the repertoire of IGH gene rearrangements to develop molecular markers for minimal residual disease in B-lineage acute lymphoblastic leukemia", *J Mol Diagn.*, 11(3):194-200 (2009).
Brüggemann, et al. "Clinical significance of minimal residual disease quantification in adult patients with standard-risk acute lymphoblastic leukemia", *Blood*, 107(3):1116-23 (2006). Epub Sep. 29, 2005.
Brüggemann, et al. "Standardized MRD quantification in European ALL trials: proceedings of the Second International Symposium on MRD assessment in Kiel, Germany, Sep. 18-20, 2008", *Leukemia*, 24(3):521-35 (2010). doi: 10.1038/leu.2009.268. Epub Dec. 24, 2009.
Bystrykh. "Generalized DNA Barcode Design Based on Hamming Codes", *PLoS ONE*, 7(5):e36852, 1-8 (2012).
Campana. "Minimal residual disease in acute lymphoblastic leukemia", *Semin Hematol.*,46(1):100-106 (2009).
Campbell et al. "Subclonal phylogenetic structures in cancer revealed by ultra-deep sequencing," *PNAS*, 105(35):13081-13086 (2008).
Casbon et al. "A method for counting PCR template molecules with application to next-generation sequencing," *Nucleic Acids Research*, 39(12): e81 (2011).
Chen et al. "A novel approach for the analysis of T-cell reconstitution by using a T-cell receptor β-based oligonucleotide microarray in hematopoietic stem cell transplantation", *Exp Hematol.*, 35(5):831-841 (2007).
Choi, et al. "Relapse in children with acute lymphoblastic leukemia involving selection of a preexisting drug-resistant subclone", *Blood*, 110(2):632-9 (2007).
Choi, et al. "Clonal evolution in B-lineage acute lymphoblastic leukemia by contemporaneous $V_H$-$V_H$ gene replacements and $V_H$-$DJ_H$ gene rearrangements", *Blood*, 87(6):2506-2512 (1996).
Churchill and Waterman. "The Accuracy of DNA Sequences: Estimating Sequence Quality", *Genomics*, 14:89-98 (1992).
Chute, et al. "Detection of immunoglobulin heavy chain gene rearrangements in classic hodgkin lymphoma using commercially available BIOMED-2 primers", *Diagn Mol Pathol.*, 17(2):65-72 (2008). doi: 10.1097/PDM.0b013e318150d695.
Costabile, et al. "Molecular approaches in the diagnosis of primary immunodeficiency diseases", *Human Mutation*, 27(12):1163-73 (2006).
Craig et al. "Identification of genetic variants using bar-coded multiplex sequencing," *Nature Methods*, 5(10): 887-893 (2008) and Supplemental Materials.
Cronn et al. "Multiplex sequencing of plant chloroplast genomes using Solexa sequencing-by-synthesis technology", *Nucleic Acids Research*, 36(19):e122, 1-11 (2008).
Curran et al. "Nucleotide sequencing of psoriatic arthritis tissue before and during methotrexate administration reveals a complex inflammatory T cell infiltrate with very few clones exhibiting features that suggest they drive the inflammatory process by recognizing autoantigens", *The Journal of Immunology*, 172:1935-1944 (2004).
Currier and Robinson. "Spectratype/immunoscope analysis of the expressed TCR repertoire", *Current Protocols in Immunology*, Supplement 38:10.28.1-10.28.24 (2000).
Davi, et al. "Lymphocytic progenitor cell origin and clonal evolution of human B-lineage acute lymphoblastic leukemia", *Blood*, 88(2):609-621 (1996).
Davis, et al. "Interrogating the repertoire: broadening the scope of peptide-MHC multimer analysis", *Nat Rev Immunol.*, 11(8):551-558 (2011). doi: 10.1038/nri3020.
Davis, et al. "Staining of cell surface human CD4 with 2'-F-pyrimidine-containing RNA aptamers for flow cytometry", *Nucleic Acids Research*, 26(17):3915-3924 (1998).
Dean, et al. "Rapid amplification of plasmid and phage DNA using Phi 29 DNA polymerase and multiply-primed rolling circle amplification", *Genome Res.*, 11(6):1095-1099 (2001).
Dedhia, et al. "Evaluation of DNA extraction methods and real time PCR optimization on formalin-fixed paraffin-embedded tissues", *Asian Pac J Cancer Prev.*, 8(1):55-59 (2007).
Deng et al. "Gene profiling involved in immature CD4+ T lymphocyte responsible for systemic lupus erythematosus", *Molecular Immunology*, 43:1497-1507 (2006).
Deschoolmeester, et al. "Tumor infiltrating lymphocytes: an intriguing player in the survival of colorectal cancer patients", *BMC Immunology*, 11:19, 12 pages (2010). doi: 10.1186/1471-2172-11-19.
Diederichsen, et al. "Prognostic value of the CD4+/CD8+ ratio of tumour infiltrating lymphocytes in colorectal cancer and HLA-DR expression on tumour cells", *Cancer Immunol Immunother.*, 52(7):423-428 (2003). Epub Apr. 15, 2003.

(56) References Cited

OTHER PUBLICATIONS

Diviacco, et al. "A novel procedure for quantitative polymerase chain reaction by coamplification of competitive templates", *Gene*, 122(2):313-320 (1992).

Dohm, et al. "Substantial biases in ultra-short read data sets from high throughput DNA sequencing", *Nucleic Acids Research*, 36:e105, 10 pages (2008).

Dou, et al. "Analysis of T cell receptor $V_\beta$ gene usage during the course of disease in patients with chronic hepatitis B", *Journal of Biomedical Science*, 5(6):428-434 (1998).

Drmanac, et al. "Human genome sequencing using unchained base reads on self-assembling DNA nanoarrays", *Science*, 327(5961):78-81 (2010). doi: 10.1126/science.1181498. Epub Nov. 5, 2009.

Droege, et al. "The Genome Sequencer FLX System—longer reads, more applications, straight forward bioinformatics and more complete data sets", *J Biotechnol.*, 136(1-2):3-10 (2008). doi: 10.1016/j.jbiotec.2008.03.021. Epub Jun. 21, 2008.

Du et al. "TCR spectratyping revealed T lymphocytes associated with graft-versus-host disease after allogeneic hematopoietic stem cell transplantation", *Leukemia & Lymphoma*, 48(8):1618-1627 (2007).

Dunn, et al. "Focus on TILs: Prognostic significance of tumor infiltrating lymphocytes in human glioma", Cancer Immun., 7:12, 16 pages (2007).

Eason et al. "Characterization of synthetic DNA bar codes in *Saccharomyces cerevisiae* genedeletion strains," *PNAS*, 101(30): 11046-11051 (2004).

Edd et al. "Controlled encapsulation of single cells into monodisperse picoliter drops", *Lab Chip*, 8(8):1262-1264 (2008).

Eid et al. "Real-time DNA sequencing from single polymerase molecules", *Science*, 323(5910):133-138 (2009). doi: 10.1126/science.1162986. Epub Nov. 20, 2008.

Flaherty et al. "Ultrasensitive detection of rare mutations using next-generation targeted resequencing", *Nucleic Acids Research*, 40(1): e2, 12 pages (2012).

Frank. "BARCRAWL and BARTAB: software tools for the design and implementation of barcoded primers for highly multiplexed DNA sequencing," *BMC Bioinformatics*, 10:362 (2009).

Freeman, et al. "Quantitative RT-PCR: Pitfalls and Potential", *Biotechniques*, 6(1):112-125 (1999).

Fridman, et al. "Prognostic and predictive impact of intra- and peritumoral immune infiltrates", *Cancer Research*, 71(17):5601-5605 (2011). doi: 10.1158/0008-5472.CAN-11-1316. Epub Aug. 16, 2011.

Fritz et al. "Alterations in the spinal cord T cell repertoire during relapsing experimental autoimmune encephalomyelitis," *J Immunol*, 164:6662-6668 (2000).

Fu et al. "Counting individual DNA molecules by the stochastic attachment of diverse labels", *PNAS*, 108(22): 9026-9031 and Supporting Materials, 8 pages (2011).

García-Castillo and Núnez, et al. "Detection of clonal immunoglobulin and T-cell receptor gene recombination in hematological malignancies: monitoring minimal residual disease", *Cardiovascular & Haematological Disorders—Drug Targets*, 9:124-135 (2009).

Gerlinger and Swanton. "How Darwinian models inform therapeutic failure initiated by clonal heterogeneity in cancer medicine", *British Journal of Cancer*, 103(8):1139-1143 (2010). doi: 10.1038/sj.bjc.6605912. Epub Sep. 28, 2010.

Germano, et al. "Clonality profile in relapsed precursor-B-ALL children by GeneScan and sequencing analyses. Consequences on minimal residual disease monitoring", *Leukemia*, 17(8):1573-1582 (2003).

Gilbert, et al. "The isolation of nucleic acids from fixed, paraffin-embedded tissues—which methods are useful when?", *PLoS One*, 2(6):e537, 12 pages (2007).

Giuggio, et al. "Evolution of the intrahepatic T cell repertoire during chronic hepatitis C virus infection", *Viral Immunology*, 18(1):179-89 (2005).

Gloor et al. "Microbiome profiling by Illumina sequencing of combinatorial sequence-tagged PCR products," *PLoS ONE*, 5(10): e15406, 15 pages (2010).

Golembowski, et al. "Clonal evolution in a primary cutaneous follicle center B cell lymphoma revealed by single cell analysis in sequential biopsies", *Immunobiology*, 201(5):631-644 (2000).

Gonzalez, et al. "Incomplete DJH rearrangements of the IgH gene are frequent in multiple myeloma patients: immunobiological characteristics and clinical implications", *Leukemia*, 17:1398-1403 (2003).

Gorski, et al. "Circulating T cell repertoire complexity in normal individuals and bone marrow recipients analyzed by CDR3 size spectratyping. Correlation with immune status", *J Immunol.*, 152(10):5109-5119 (1994).

Gratama and Kern. "Flow cytometric enumeration of antigen-specific T lymphocytes", *Cytometry A*, 58(1):79-86 (2004).

Green, et al. "Clonal diversity of Ig and T-cell-receptor gene rearrangements identifies a subset of childhood B-precursor acute lymphoblastic leukemia with increased risk of relapse", *Blood*, 92(3):952-958 (1998).

Gunderson et al. "Decoding Randomly Ordered DNA Arrays", *Genome Research*, 14:870-877 (2004).

Guo, et al. "Sequence changes at the V-D junction of the $V_H 1$ heavy chain of anti-phosphocholine antibodies alter binding to and protection against *Streptococcus pneumoniae*", *Int Immunol.*, 9(5):665-677 (1997).

Gurrieri, et al. "Chronic lymphocytic leukemia B cells can undergo somatic hypermutation and intraclonal immunoglobulin $V_H DJ_H$ gene diversification", *J Exp Med.*, 196(5):629-639 (2002).

Halldórsdóttir, et al. "Application of BIOMED-2 clonality assays to formalin-fixed paraffin embedded follicular lymphoma specimens: superior performance of the IGK assays compared to IGH for suboptimal specimens", *Leukemia & Lymphoma*, 48(7):1338-1343 (2007).

Hamady, et al. "Error-correcting barcoded primers for pyrosequencing hundreds of samples in multiplex", *Nature Methods*, 5(3):235-237 (2008). doi: 10.1038/nmeth.1184. Epub Feb. 10, 2008.

Han et al. "Immunorepertoire analysis by multiplex PCR amplification and high throughput sequencing", *The Journal of Immunology*, 182:42.6, 1 page (2009).

Harismendy et al. "Evaluation of next generation sequencing platforms for population targeted sequencing studies", *Genome Biology*, 10:R32, 13 pages (2009).

Hawkins, et al. "Whole genome amplification—applications and advances", *Curr Opin Biotechnol.*, 13(1):65-67 (2002).

He, et al. "IgH gene rearrangements as plasma biomarkers in Non-Hodgkin's lymphoma patients", *Oncotarget*, 2(3):178-185 (2011).

Heger, M. "Studies Highlight Challenges of Immune Repertoire Sequencing's Clinical Applicability", available at http://www.genomeweb.com/sequencing/studies-highlight-challenges-immune-repertoire-sequencings-clinical-applicabilit?hq_e=el&hq_m=966798&hq_I=10&hq_v=2357e2f0b3. Accessed Apr. 6, 2011.

Hensel et al. "Simultaneous identification of bacterial virulence genes by negative selection", *Science*, 269(5222): 400-403 (1995).

Holt. "Q &A: BC cancer agency's Robert Holt on sequencing the immune repertoire in immune reconstitution," *Genome Web* (www.genomeweb.com) Jun. 30, 2009.

Holt and Jones. "The new paradigm of flow cell sequencing", *Genome Research*, 18:839-846 (2008).

Hosono, et al. "Unbiased whole-genome amplification directly from clinical samples", *Genome Res.*, 13(5):954-964 (2003). Epub Apr. 14, 2003.

Hoven, et al. "Detection and isolation of antigen-specific B cells by the fluorescence activated cell sorter (FACS)", *J Immunol Methods*, 117(2):275-284, Abstract Only, 2 pages (1989).

Howe, et al. "T cell receptor clonotype analysis of T cell responses: Diagnostic application of a clonotypic database", *Blood*, 102:Abstract 3918 (2003).

Huh, et al. "Microfluidics for flow cytometric analysis of cells and particles", *Physiol Meas.*, 26(3):R73-98, Abstract Only (2005). Epub Feb. 1, 2005.

(56) References Cited

OTHER PUBLICATIONS

Huijsmans, et al. "Comparative analysis of four methods to extract DNA from paraffin-embedded tissues: effect on downstream molecular applications", *BMC Res Notes*, 3:239, 9 pages (2010). doi: 10.1186/1756-0500-3-239.

Illumina. Data Sheet: Sequencing. Genomic Sequencing. Pub. No. 770.2008-016 Reference states: "Current as of Jan. 30, 2009." (2010.

Ishii et al. "Isolation and expression profiling of genes upregulated in the peripheral blood cells of systemic lupus erythematosus patients," *DNA Research*, 12:429-439 (2005).

Jacobi et al. "Activated memory B cell subsets correlate with disease activity in systemic lupus erythematosus: delineation by expression of CD27, IgD, and CD95", *Arthritis & Rheumatism*, 58(6):1762-1773 (2008).

Jacobi et al. "Correlation between circulating $CD27^{high}$ plasma cells and disease activity in patients with systemic lupus erythematosus" *Arthritis & Rheumatism*, 48(5):1332-1342 (2003).

Jalla, et al. "Enumeration of lymphocyte subsets using flow cytometry: Effect of storage before and after staining in a developing country setting", *Indian J Clin Biochem.*, 19(2):95-99 (2004). doi: 10.1007/BF02894264.

Jena, et al. "Amplification of genes, single transcripts and cDNA libraries from one cell and direct sequence analysis of amplified products derived from one molecule", *J. Immunol. Methods*, 190:199-213 (1996).

Kato et al. "Analysis of accumulated T cell clonotypes in patients with systemic lupus erythematosus," *Arthritis & Rheumatism*, 43(12):2712-2721 (2000).

Kedzierska, et al. "Tracking phenotypically and functionally distinct T cell subsets via T cell repertoire diversity", *Mol Immunol.*, 45(3):607-618 (2008). Epub Aug. 24, 2007.

Kim, et al. "An efficient and reliable DNA extraction method for preimplantation genetic diagnosis: a comparison of allele drop out and amplification rates using different single cell lysis methods", *Fertility and Sterility*, 92: 814-818 (2009).

Kim, et al. "Polony multiplex analysis of gene expression (PMAGE) in mouse hypertrophic cardiomyopathy", *Science*, 316(5830):1481-1484 (2007).

Kinde et al. "Detection and quantification of rare mutations with massively parallel sequencing," *PNAS*, 108(23): 9530-9535 and Supporting Information, 16 pages (2011).

Kivioja et al. "Counting absolute numbers of molecules using unique molecular identifiers," *Nature Methods*, 9(1): 72-76 (2012).

Kobari, et al. "T cells accumulating in the inflamed joints of a spontaneous murine model of rheumatoid arthritis become restricted to common clonotypes during disease progression", *Int Immunol.*, 16(1):131-138 (2004).

Koch, et al. "Tumor infiltrating T lymphocytes in colorectal cancer: Tumor-selective activation and cytotoxic activity in situ," *Ann Surg.*, 244(6):986-992; discussion 992-993 (2006).

Langerak, et al. "Immunoglobulin/T-cell receptor clonality diagnostics", *Expert Opin. Med. Diagn.*, 1(3):451-461 (2007).

Langerak, et al. "Polymerase chain reaction-based clonality testing in tissue samples with reactive lymphoproliferations: usefulness and pitfalls. A report of the BIOMED-2 Concerted Action BMH4-CT98-3936", *Leukemia*, 21(2):222-229 (2007).

Laplaud et al. "Blood T-cell receptor β chain transcriptome in multiple sclerosis. Characterization of the T cells with altered CDR3 length distribution", *Brain*, 127:981-995 (2004).

Laplaud et al. "Serial blood T cell repertoire alterations in multiple sclerosis patients; correlation with clinical and MRI parameters", *Journal of Neuroimmunology*, 177(1-2):151-160 (2006).

Lassmann, et al. "Application of BIOMED-2 primers in fixed and decalcified bone marrow biopsies: analysis of immunoglobulin H receptor rearrangements in B-cell non-Hodgkin's lymphomas", *J Mol Diagn.*, 7(5):582-591 (2005).

Lee, et al. "Characterization of circulating T cells specific for tumor-associated antigens in melanoma patients", *Nat Med.*, 5(6):677-685, Abstract Only (1999).

Lee, et al. "Prognostic implications of type and density of tumour-infiltrating lymphocytes in gastric cancer", *Br J Cancer*,99(10):1704-1711 (2008). doi: 10.1038/sj.bjc.6604738. Epub Oct. 21, 2008.

Leisner, et al. "One-pot, mix-and-read peptide-MHC tetramers", *PLoS One*, 3(2):e1678, 11 pages (2008). doi: 10.1371/journal.pone.0001678.

Leone, et al. "Molecular beacon probes combined with amplification by NASBA enable homogeneous, real-time detection of RNA", *Nucleic Acids Research*, 26(9):2150-2155 (1998).

Li, et al. "Utilization of Ig heavy chain variable, diversity, and joining gene segments in children with B-lineage acute lymphoblastic leukemia: implications for the mechanisms of VDJ recombination and for pathogenesis", *Blood*, 103(12):4602-4609 (2004).

Li, et al. "An improved one-tube RT-PCR protocol for analyzing single-cell gene expression in individual mammalian cells", *Anal. Bioanal. Chem.*, 397: 1853-1859 (2010).

Li, et al. "Clonal rearrangements in childhood and adult precursor B acute lymphoblastic leukemia: a comparative polymerase chain reaction study using multiple sets of primers", *Eur J Haematol.*, 63(4):211-218 (1999).

Li, et al. "Detailed clonality analysis of relapsing precursor B acute lymphoblastic leukemia: implications for minimal residual disease detection", *Leukemia Research*, 25:1033-1045 (2001).

Li, et al. "Sequence analysis of clonal immunoglobulin and T-cell receptor gene rearrangements in children with acute lymphoblastic leukemia at diagnosis and at relapse: implications for pathogenesis and for the clinical utility of PCR-based methods of minimal residual disease detection", *Blood*, 102:4520-4526 (2003).

Liedtke, et al. "A comparison of methods for RNA extraction from lymphocytes for RT-PCR", *PCR Methods and Applications*, 4(3):185-187 (1994).

Liu, et al. "CD127 expression inversely correlates with FoxP3 and suppressive function of human CD4+ T reg cells", *J Exp Med.*, 203(7):1701-1711 (2006). Epub Jul. 3, 2006.

Lovisa, et al. "IGH and IGK gene rearrangements as PCR targets for pediatric Burkitt's lymphoma and mature B-ALL MRD analysis", *Lab Invest.*, 89(10):1182-1186 (2009).

Luo et al. "Analysis of the interindividual conservation of T cell receptor α- and β-chain variable regions gene in the peripheral blood of patients with systemic lupus erythematosus", *Clinical & Experimental Immunology*, 154(3):316-324 (2008).

Manrao, et al. "Reading DNA at single-nucleotide resolution with a mutant MspA nanopore and phi29 DNA polymerase", *Nat Biotechnol.*, 30(4):349-353 (2012). doi: 10.1038/nbt.2171.

Mardis. "Next-generation DNA sequencing methods", *Annu. Rev. Genomics Hum. Genet.*, 9:387-402 (2008). doi: 10.1146/annurev.genom.9.081307.164359.

Margulies, et al. "Genome sequencing in microfabricated high-density picolitre reactors", *Nature*, 437(7057):376-380 (2005). Epub Jul. 31, 2005.

Mato et al. "Correlation of clonal T cell expansion with disease activity in systemic lupus erythematosus", *Int Immunol.*, 9(4):547-554 (1997).

Matolcsy, et al. "Clonal evolution of B cells in transformation from low- to high-grade lymphoma", *Eur. J. Immunol.*, 29(4):1253-1264 (1999).

Matsumoto et al. "CDR3 spectratyping analysis of the TCR repertoire in Myasthenia Gravis", *The Journal of Immunology*, 176:5100-5107 (2006).

Matsumoto et al. "Complementarity-determining region 3 spectratyping analysis of the TCR repertoire in multiple sclerosis", *The Journal of Immunology*, 170:4846-4853 (2003).

McCloskey et al. "Encoding PCR products with batch-stamps and barcodes," *Biochem. Genet.*, 45: 761-767 (2007).

Meleshko, et al. "Rearrangements of IgH, TCRD and TCRG genes as clonality marker of childhood acute lymphoblastic leukemia", *Experimental Oncology*, 27(4):319-324 (2005).

Menezes et al. "A public T cell clonotype within a heterogeneous autoreactive repertoire is dominant in driving EAE", *J Clin Invest*, 117(8):2176-2185 (2007).

Metzker, "Sequencing Technologies—The Next Generation", *Nature Reviews, Genetics*, 11:31-46 (2010).

(56) References Cited

OTHER PUBLICATIONS

Meyer et al. "Targeted high-throughput sequencing of tagged nucleic acid samples," *Nucleic Acids Research*, 35(15): e97 (2007).
Michalek, et al. "Detection and long-term in vivo monitoring of individual tumor-specific T cell clones in patients with metastatic melanoma", *J Immunol.*, 178(11):6789-6795 (2007).
Miltenyi, et al. "High gradient magnetic cell separation with MACS", *Cytometry*, 11(2):231-238 (1990).
Miner et al. "Molecular barcodes detect redundancy and contamination in hairpin-bisulfite PCR", *Nucleic Acids Research*, 32(17): e135, 4 pages (2004).
Moody, et al. "Antigen-specific B cell detection reagents: use and quality control", *Cytometry A.*, 73(11):1086-1092 (2008). doi: 10.1002/cyto.a.20599.
Morozova et al. "Applications of New Sequencing Technologies for Transcriptome Analysis", *Annu. Rev. Genomics Hum. Genet.*, 10:135-151 (2009).
Morrissy et al. "Next-generation tag sequencing for cancer gene expression profiling", *Genome Research*, 19:1825-1835 (2009).
Moss, et al. "The human T cell receptor in health and disease", *Annu. Rev. Immunol.*, 10:71-96 (1992).
Muraro et al. "Molecular tracking of antigen-specific T cell clones in neurological immune-mediated disorders", *Brain*, 126(Pt 1):20-31 (2003).
Naito, et al. "CD8$^+$ T cells infiltrated within cancer cell nests as a prognostic factor in human colorectal cancer", *Cancer Research*, 58(16):3491-3494 (1998).
Nardi, et al. "Quantitative monitoring by polymerase colony assay of known mutations resistant to ABL kinase inhibitors", *Oncogene*, 27(6):775-782 (2008). Epub Aug. 6, 2007, 1-8.
Neale, et al. "Comparative analysis of flow cytometry and polymerase chain reaction for the detection of minimal residual disease in childhood acute lymphoblastic leukemia", *Leukemia*, 18(5):934-938 (2004).
Needleman and Wunsch. "A general method applicable to the search for similarities in the amino acid sequence of two proteins", *J Mol Biol.*, 48(3):443-453 (1970).
Nelson. "CD20$^+$ B cells: the other tumor-infiltrating lymphocytes", *The Journal of Immunology*, 185(9):4977-4982 (2010). doi: 10.4049/jimmunol.1001323.
Newman, et al. "Identification of an antigen-specific B cell population", *J Immunol Methods*, 272(1-2):177-187, Abstract Only (2003).
Nguyen et al. "Identification of errors introduced during high throughput sequencing of the T cell receptor repertoire" *BMC Genomics*, 12:106, 13 pages (2011).
Nosho, et al. "Tumour-infiltrating T-cell subsets, molecular changes in colorectal cancer, and prognosis: cohort study and literature review", *J Pathol.*, 222(4):350-366 (2010). doi: 10.1002/path.2774.
Novak, et al. "Single-cell multiplex gene detection and sequencing With microfluidically generated agarose emulsions", *Angewandte Chemie*, 50(2):390-395, with supplemental materials (2011).
Oble, et al. "Focus on TILs: prognostic significance of tumor infiltrating lymphocytes in human melanoma", *Cancer Immunity*, 9:3, 20 pages (2009).
Ogle, et al. "Direct measurement of lymphocyte receptor diversity", *Nucleic Acids Research*, 31(22):e139, 6 pages (2003).
Ohtani. "Focus on TILs: prognostic significance of tumor infiltrating lymphocytes in human colorectal cancer", *Cancer Immunity*, 7:4, 9 pages (2007).
Okajima et al. "Analysis of T cell receptor Vβ diversity in peripheral CD4$^+$ and CD8$^+$ T lymphocytes in patients with autoimmune throid diseases", *Clinical & Experimental Immunology*, 155:166-172 (2008).
Okello et al. "Comparison of methods in the recovery of nucleic acids from archival formalin-fixed paraffin-embedded autopsy tissues", *Anal Biochem.*, 400(1):110-117 (2010). doi: 10.1016/j.ab.2010.01.014. Epub Jan. 15, 2010.
Packer and Muraro. "Optimized clonotypic analysis of T-cell receptor repertoire in immune reconstitution", *Experimental Hematology*, 35(3):516-521 (2007).

Pan, et al. "A new FACS approach isolates hESC derived endoderm using transcription factors", *PLoS One*, 6(3):e17536, 9 pages (2011). doi: 10.1371/journal.pone.0017536.
Panzer-Grümayer et al. "Immunogenotype changes prevail in relapses of young children with *TEL-AML1*-positive acute lymphoblastic leukemia and derive mainly from clonal selection", *Clin Cancer Research*, 11(21):7720-7727 (2005).
Parameswaran et al. "A pyrosequencing-tailored nucleotide barcode design unveils opportunities for large-scale sample multiplexing", *Nucleic Acids Research*, 35(19): e130, 9 pages (2007).
PCT/US2009/006053, International Search Report dated Jun. 15, 2010, 6 pages.
PCT/US2011/000791, International Search Report and Written Opinion dated Sep. 22, 2011, 13 pages.
PCT/US2011/000792, International Search Report and Written Opinion dated Oct. 19, 2011, 12 pages.
PCT/US2012/069310, International Search Report and Written Opinion dated Feb. 26, 2013, 7 pages.
Pels et al. "Clonal evolution as pathogenetic mechanism in relapse of primary CNS lymphoma", *Neurology*, 63(1):167-169 (2004).
Pira et al. "Human naive CD4 T-cell clones specific for HIV envelope persist for years in vivo in the absence of antigenic challenge", *J Acquir Immune Defic Syndr.*, 40(2):132-139 (2005).
Pop and Salzberg. "Bioinformatics challenges of new sequencing technology", *NIH, Trends Genet.*, 24(3): 142-149 (2008).
Qui et al. "DNA sequence-based "bar codes" for tracking the origins of expressed sequence tags from a maize cDNA library constructed using multiple mRNA sources," *Plant Physiology*, 133(2): 475-481 (2003).
Ray, et al. "Single cell multiplex PCR amplification of five dystrophin gene exons combined with gender determination", *Molecular Human Reproduction*, 7(5): 489-494 (2001).
Reddy and Georgiou. "Systems analysis of adaptive immunity by utilization of high-throughput technologies", *Current Opinion in Biotechnology*, 22(4):584-589 (2011).
Reinartz et al. "Massively parallel signature sequencing (MPSS) as a tool for in-depth quantitative gene expression profiling in all organisms", *Brief Funct Genomic Proteomic.*, 1(1):95-104 (2002).
Ria, et al. "Collagen-specific T-cell repertoire in blood and synovial fluid varies with disease activity in early rheumatoid arthritis", *Arthritis Res Ther.*, 10(6):R135, 18 pages (2008). Epub Nov. 17, 2008.
Rickinson and Moss. "Human cytotoxic T lymphocyte responses to Epstein-Barr virus infection", *Annu Rev Immunol.*, 15:405-431 (1997).
Risitano et al. "In-vivo dominant immune responses in aplastic anaemia: molecular tracking of putatively pathogenetic T-cell clones by TCRβ-CDR3 sequencing", *Lancet*, 364:355-364 (2004).
Robins, H. et al. "Ultra-sensitive detection of rare T cell clones", *Immunol Methods*, 375(1-2):14-19 (2012).
Rosenquist, et al. "Clonal evolution as judged by immunoglobulin heavy chain gene rearrangements in relapsing precursor-B acute lymphoblastic leukemia", *Eur J Haematol.*, 63(3):171-179 (1999).
Rougemont, et al. "Probabilistic base calling of Solexa sequencing data", *BMC Bioinformatics*, 9:431, 12 pages (2008).
Ryan et al. "Clonal evolution of lymphoblastoid cell lines", *Laboratory Investigation*, 86(11):1193-1200 (2006). Epub Oct. 2, 2006.
Salzberg. "Mind the gaps," *Nature Methods*, 7(2): 105-106 (2010).
Sato et al. "Intraepithelial CD8$^+$ tumor-infiltrating lymphocytes and a high CD8$^+$/regulatory T cell ratio are associated with favorable prognosis in ovarian cancer", *PNAS*, 102(51):18538-18543 (2005). Epub Dec. 12, 2005.
Satoh et al. "Pretreatment with restriction enzyme or bovine serum albumin for effective PCR amplification of Epstein-Barr virus DNA in DNA extracted from paraffin-embedded gastric carcinoma tissue", *J Clin Microbiol.*, 36(11):3423-3425 (1998).
Schaufelberger et al. "An uneven expression of T cell receptor V genes in the arterial wall and peripheral blood in giant cell arteritis", *Inflammation*, 31(6):372-383 (2008).
Schmitt et al. "Detection of ultra-rare mutations by next-generation sequencing," *PNAS*, 109(36): 14508-14513 and Supporting Information, 9 pages (2012).

(56) References Cited

OTHER PUBLICATIONS

Schøller et al. "Analysis of T cell receptor αβ variability in lymphocytes infiltrating melanoma primary tumours and metastatic lesions", *Cancer Immunol Immunother*. 39(4):239-248 (1994).
Schreiber et al. "Cancer immunoediting: integrating immunity's roles in cancer suppression and promotion", *Science*, 331(6024):1565-1570 (2011). doi: 10.1126/science.1203486.
Schwab et al. "CD8+ T-cell clones dominate brain infiltrates in Rasmussen encephalitis and persist in the periphery", *Brain*, 132:1236-1246 (2009).
Schweiger et al. "Genome-wide massively parallel sequencing of formaldehyde fixed-paraffin embedded (FFPE) tumor tissues for copy-number- and mutation-analysis", *PLoS One*, 4(5):e5548, 7 pages (2009). doi: 10.1371/journal.pone.0005548. Epub May 14, 2009.
Sehouli et al. "Epigenetic quantification of tumor-infiltrating T-lymphocytes" *Epigenetics*, 6(2):236-246 (2011). Epub Feb. 1, 2011.
Sfanos et al. "Phenotypic analysis of prostate-infiltrating lymphocytes reveals TH17 and Treg skewing", *Clinical Cancer Research*, 14(11):3254-3261 (2008). doi: 10.1158/1078-0432.CCR-07-5164.
Shen et al. "Comparing platforms for *C. elegans* mutant identification using high-throughput whole-genome sequencing", *PLoS One*, 3(12):e4012, 6 pages (2008).
Shendure and Ji. "Next-generation DNA sequencing", *Nature Biotechnology*, 26(10):1135-1145 (2008).
Shiroguchi et al. "Digital RNA sequencing minimizes sequence-dependent bias and amplification noise with optimized single-molecule barcodes," *PNAS*, 109(4):1347-1352 (2012).
Shoemaker et al. "Quantitative phenotypic analysis of yeast deletion mutants using a highly parallel molecular bar-coding strategy," *Nature Genetics*, 14(4): 450-456 (1996).
Sing et al. "A molecular comparison of T Lymphocyte populations infiltrating the liver and circulating in the blood of patients with chronic hepatitis B: evidence for antigen-driven selection of a public complementarity-determining region 3 (CDR3) motif", *Hepatology*, 33(5):1288-1298 (2001).
Skulina et al. "Multiple Sclerosis: Brain-infiltrating CD8+ T cells persist as clonal expansions in the cerebrospinal fluid and blood", *PNAS*, 101(8):2428-2433 (2004).
Smith, et al. "Comparison of biosequences", *Advances in Applied Mathematics*, 2:482-489 (1981).
Smith et al. "Rapid whole-genome mutational profiling using next-generation sequencing technologies", *Genome Research*, 18:1638-1642 (2008).
Sramkova, et al. "Detectable minimal residual disease before allogeneic hematopoietic stem cell transplantation predicts extremely poor prognosis in children with acute lymphoblastic leukemia", *Pediatr. Blood Cancer*, 48(1):93-100 (2007).
Srinivasan et al. "Effect of fixatives and tissue processing on the content and integrity of nucleic acids", *Am J Pathol.*, 161(6):1961-1971 (2002).
Steenbergen, et al. "Distinct ongoing Ig heavy chain rearrangement processes in childhood B-precursor acute lymphoblastic leukemia", *Blood*, 82(2):581-589 (1993).
Steward et al. "A polymerase chain reaction study of the stability of Ig heavy-chain and T-cell receptor delta gene rearrangements between presentation and relapse of childhood B-lineage acute lymphoblastic leukemia", *Blood*, 83(5):1355-1362 (1994).
Struyk et al. "T cell receptors in rheumatoid arthritis", *Arthritis & Rheumatism*, 38(5):577-589 (1995).
Sumida et al. "T cell receptor repertoire of infiltrating T cells in lips of Sjogren's syndrome patients", *J Clin Invest.*, 89:681-685 (1992).
Sumida et al. "T cell receptor Vα repertoire of infiltrating T cells in labial salivary glands from patients with Sjögren's syndrome", *J Rheumatol.*, 21:1655-1661 (1994).
Swarup and Rajeswari. "Circulating (cell-free) nucleic acids—a promising, non-invasive tool for early detection of several human diseases", FEBS Letters, 581(5):795-799 (2007). Epub Feb. 2, 2007.
Szczepanski et al. "Comparative analysis of Ig and TCR gene rearrangements at diagnosis and at relapse of childhood precursor-B-ALL provides improved strategies for selection of stable PCR targets for monitoring of minimal residual disease", *Blood*, 99(7):2315-2523 (2002).
Szczepanski et al. "Why and how to quantify minimal residual disease in acute lymphoblastic leukemia?", *Leukemia*, 21(4):622-626 (2007). Epub Feb. 15, 2007.
Tackenberg et al. "Clonal expansions of CD4+ B helper T cells in autoimmune myasthenia gravis", *European Journal of Immunology*, 37(3):849-863 (2007).
Tajiri et al. "Cell-microarray analysis of antigen-specific B-cells: single cell analysis of antigen receptor expression and specificity", *Cytometry Part A*, 71A: 961-967 (2007).
ten Bosch et al. "Keeping Up With the Next Generation Massively Parallel Sequencing in Clinical Diagnostics", *Journal of Molecular Diagnostics*, 10(6):484-492 (2008).
Thiel, et al. "Antigen-specific cytometry—new tools arrived!", *Clin Immunol.*, 111(2):155-161, Abstract Only (2004).
Thornhill et al. "A comparison of different lysis buffers to assess allele dropout from single cells for preimplantation genetic diagnosis", *Prenatal Diagnosis*, 21:490-497 (2001).
Tokimitsu et al. "Single lymphocyte analysis with a microwell array chip", *Cytometry Part A*, 71A:1003-1010 (2007).
Umibe et al. "Clonal expansion of T cells infiltrating in the airways of non-atopic asthmatics", *Clinical & Experimental Immunology*, 119(3):390-397 (2000).
Unrau and Deugau. "Non-cloning amplification of specific DNA fragments from whole genomic DNA digests using DNA 'indexers'", *Gene.*, 145(2):163-169, Abstract Only, 2 pages (1994).
Uppaluri et al. "Focus on TILs: prognostic significance of tumor infiltrating lymphocytes in head and neck cancers", *Cancer Immunity*, 8:16, 10 pages (2008).
Varley and Mitra. "Nested patch PCR enables highly multiplexed mutation discovery in candidate genes", *Genome Research*, 18: 1844-1850 (2008).
Vlassov, et al. Circulating nucleic acids as a potential source for cancer biomarkers, *Curr Mol Med.*, 10(2):142-165 (2010).
Wang, et al. "Balanced-PCR amplification allows unbiased identification of genomic copy changes in minute cell and tissue samples", *Nucleic Acids Research*, 32(9):e76, 10 pages (2004).
Wang, et al. "High throughput sequencing reveals a complex pattern of dynamic interrelationships among human T cell subsets", *PNAS*, 107(4): 1518-1523 (2010).
Warren et al. "Exhaustive T-cell repertoire sequencing of human peripheral blood samples reveals signatures of antigen selection and a directly measured repertoire size of at least 1 million clonotypes", *Genome Res.*, 21(5):790-797 (2011). doi: 10.1101/gr.115428.110. Epub Feb. 24, 2011.
Warren et al. "Profiling model T-cell metagenomes with short reads", *Bioinformatics*, 25(4):458-464 (2009).
Weiss et al. "Clonal Rearrangements of T-Cell Receptor Genes in Mycosis Fungoides and Dermatopathic Lymphadenopathy", *The New England Journal of Medicine*, 313(9):539-544 (1985).
Wells, et al. "Strategies for preimplantation genetic diagnosis of single gene disorders by DNA amplification", *Prenatal Diagnosis*, 18(13):1389-1401 (1998).
Westermann and Pabst. "Distribution of lymphocyte subsets and natural killer cells in the human body", Clin Investig., 70(7):539-544 (1992).
Wetmur and Chen. "An emulsion polymerase chain reaction-based method for molecular haplotyping", *Methods in Molecular Biology*, 410: 351-361 (1996).
Wetmur and Chen. "Linking emulsion PCR haplotype analysis", chapter 11, Park, D.J. (ed.), *PCR Protocols, Methods in Molecular Biology*, 687: 165-175 (2011).
Wetmur et al. "Molecular haplotyping by linking emulsion PCR: analysis of paraoxonase 1 haplotypes and phenotypes", *Nucleic Acids Research*, 33(8):2615-2619 (2005).
Wlodarski et al. "Molecular strategies for detection and quantitation of clonal cytotoxic T-cell responses in aplastic anemia and myelodysplastic syndrome", *Blood*, 108(8):2632-2641 (2006).
Wlodarski et al. "Pathologic clonal cytotoxic T-cell responses: nonrandom nature of the T-cell-receptor restriction in large granular lymphocyte leukemia", *Blood*, 106:2769-2779 (2005).

(56) References Cited

OTHER PUBLICATIONS

Wood, et al. "Using next-generation sequencing for high resolution multiplex analysis of copy number variation from nanogram quantities of DNA from formalin-fixed paraffin-embedded specimens", *Nucleic Acids Research*, 38(14):e151, 11 pages (2010). doi: 10.1093/nar/gkq510. Epub Jun. 4, 2010.
Yin et al. "Antiretroviral therapy restores diversity in the T-cell receptor Vβ repertoire of CD4 T-cell subpopulations among human immunodeficiency virus type 1-infected children and adolescents", *Clinical and Vaccine Immunology*, 16(9):1293-1301 (2009).
Yon and Fried. "Precise gene fusion by PCR", *Nucleic Acids Research*, 17(12):4895, 1 page (1989).
Yu and Fu. "Tumor-infiltrating T lymphocytes: friends or foes?", *Lab Invest.*, 86(3):231-245 (2006).
Zaliova, et al. "Quantification of fusion transcript reveals a subgroup with distinct biological properties and predicts relapse in BCR/ABL-positive ALL: implications for residual disease monitoring", *Leukemia*, 23(5):944-951 (2009).
Zeng et al. "High-performance single cell genetic analysis using microfluidic emulsion generator arrays", *Anal. Chem.*, 82(8):3183-3190 (2010).
Zhou et al. "High throughput analysis of TCR-β rearrangement and gene expression in single cells", *Laboratory Investigation*, 86:314-621 (2006).
Zhou et al. "Isolation of purified and live Foxp3+ regulatory T cells using FACS sorting on scatter plot", *J Mol Cell Biol.*,2(3):164-169 (2010). doi: 10.1093/jmcb/mjq007. Epub Apr. 29, 2010.
Zimmerman and Mannhalter. "Technical aspects of quantitative competitive PCR", *Biotechniques*, 21:268-279 (1996).
Singapore Application No. 11201500313Y, Search Report and Written Opinion mailed Dec. 9, 2015, 11 pages.
Abath, et al. "Single-tube nested PCR using immobilized internal primers", *Biotechniques*. 33(6): 1210-2, 1214 (2002).
Ahmadzadeh et al. "FOXP3 expression accurately defines the population of intratumoral regulatory T cells that selectively accumulate in metastatic melanoma lesions", *Blood*, 112(13): 4953-4960 (2008).
Altin et al. "The role of CD45 and CD45-associated molecules in T cell activation", *Immunology and Cell Biology*, 75: 430-445 (1997).
Arnaout. "Specificity and overlap in gene segment-defined antibody repertoires", *BMC Genomics*, 6: 148 (2005).
Brochet et al. "IMGT/V-QUEST: the highly customized and integrated system for IG and TR standardized V-J and V-D-J sequence analysis", *Nucleic Acids Research*, vol. 36, Web Server issue W503-W508 (2008).
Boudinot et al. "New perspectives for large-scale repertoire analysis of immune receptors", *Molecular Immunology*, 45: 2437-2445 (2008).
Carlson et al. "Profiling the repertoire of TCRB usage in induced and natural Treg cells", *The Journal of Immunology*, 186: 62.5, Abstract (2011).
Carlson, et al. "Immune Profiling Suggests an IGH Signaling-Dependent Subtype of Aggressive B-ALL", *Blood*, 120: 1428, Abstract (2012).
Carlson, et al. "Deep sequencing of the human TCRγ and TCRβ repertoires provides evidence that TCRβ rearranges after αβ, γδT cell commitment". Presented at the ASHG 2011 Conference. Oct. 2011. Poster. 1 page.
Chan et al. "Evaluation of Nanofluidics Technology for High-Throughput SNP Genotyping in a Clinical Setting", *The Journal of Molecular Diagnostics*, 13(3): 305-312 (2011).
Citri et al. "Comprehensive qPCR profiling of gene expression in single neuronal cells", *Nature Protocols*, 7(1): 118-127 (2012).
Damle et al. "B-cell chronic lymphocytic leukemia cells express a surface membrane phenotype of activated, antigen-experienced B lymphocytes", *Blood*, 99(11): 4087-93 (2002).
De Bona et al. "Optimal spliced alignments of short sequence reads", *Bioinformatics*, 9(Suppl 10):O7, 2 pages (2008).
Decoste et al. "Relative and Absolute Quantitative Real-Time PCR-Based Quantifications of *hcnC* and *phlD* Gene Transcripts in Natural Soil Spiked with *Pseudomonas* sp. Strain LBUM300", *Applied and Environmental Microbiology*, 77(1): 41-47 (2011).
DeKosky et al. "High-throughput sequencing of the paired human immunoglobulin heavy and light chain repertoire", *Nature Biotechnology*, 31(2): 166-169 (2013).
Desmarais, et al. "Deep profiling of the mouse TCRβ CDR3 region in thymus and spleen". Oct. 2010. Poster. 1 page.
DiLuvio et al. "Identical TCRβ-chain rearrangements in streptococcal angina and skin lesions of patients with psoriasis vulgaris", *J Immunol.*, 176(11 ): 7104-11 (2006).
Do and Batzoglou. "What is the expectation maximization algorithm?", *Nature Biotechnology*, 28(8): 897-899 (2008).
Drossman, et al. "High-speed separations of DNA sequencing reactions by capillary electrophoresis", *Anal Chem.*, 62(9): 900-903 (1990).
Elkord et al. "T regulatory cells in cancer: recent advances and therapeutic potential", *Expert Opinion on Biological Therapy*, 10(11): 1573-1586 (2010).
Emerson et al. "Defining the Alloreactive T Cell Repertoire Using High-Throughput Sequencing of Mixed Lymphocyte Reaction Culture", *PLoS One*, 9(11): e111943 (2014).
Erlich, et al. "Alta-Cyclic: a self-optimizing base caller for next-generation sequencing", *Nat Methods.*, 5(8): 679-682 (2008). doi: 10.1038/nmeth.1230. Epub Jul. 6, 2008.
Esendagli et al. "Malignant and non-malignant lung tissue areas are differentially populated by natural killer cells and regulatory T cells in non-small cell lung cancer", *Lung Cancer*, 59(1): 32-40 (2008).
European Application No. 12856834.2, Extended European Search Report dated Jul. 7, 2015, 8 pages.
European Application No. 13195379.6, European Search Report and Opinion dated Mar. 13, 2014, 6 pages.
Ferradini et al. "Analysis of T Cell Receptor Variability in Tumor-infiltrating Lymphocytes from a Human Regressive Melanoma", *J. Clin. Invest.*, pp. 1183-190 (1993).
Fisher et al. "The Relation Between the Number of Species and the Number of Individuals in a Random Sample of an Animal Population", *Journal of Animal Ecology*, 12(1): 42-58 (1943).
Furmanski, et al. "Public T cell receptor β-chains are not advantaged during positive selection", *The Journal of Immunology*, 180(2): 1029-39 (2008).
Gomes, et al. "Single-tube nested PCR using immobilized internal primers for the identification of dengue virus serotypes", *J Virol Methods.*, 145(1):76-9 (2007). Epub Jun. 15, 2007.
Gupta, Pushpendra K. "Single-molecule DNA sequencing technologies for future genomics research", *Trends Biotechnol.*, 26(11): 602-611 (2008). doi: 10.1016/j.tibtech.2008.07.003. Epub Aug. 21, 2008.
Harris et al. "Single-Molecule DNA Sequencing of a Viral Genome", *Science*, 320: 106-109 (2008).
Heger. "Roche's 454 Eyes Immune Repertoire Sequencing as Key Application for Long-Read Platform". Feb. 2, 2010. 4 pages. http://www.genomeweb.com/print/932624.
Huse et al. "Accuracy and quality of massively parallel DNA pyrosequencing", *Genome Biology*, 8: R143 (2007).
Illumina Systems & Software, Technology Spotlight, DNA Sequencing with Solexa® Technology, Illumina, Inc., Pub. No. 770-2007-002, 4 pages (2007).
Illumina. "Technical Note: Systems and Software. Calling sequencing SNPs", 3 pages (2010).
Jabara et al. "Accurate sampling and deep sequencing of the HIV-1 protease gene using a Primer ID", *PNAS*, 108(50): 20166-20171 (2011).
Kita, et al. "T cell receptor clonotypes in skin lesions from patients with systemic lupus erythematosus", *Journal of Investigative Dermatology*,110(1): 41-6 (1988).
Kojima et al. "PCR amplification from single DNA molecules on magnetic beads in emulsion: application for high-throughput screening of transcription factor targets", *Nucleic Acids Research*, 33: 17, e150, 9 pages (2005).
Kou, et al. "T-Cell receptor Vbeta repertoire CDR3 length diversity differs within CD45RA and CD45RO T-cell subsets in healthy and human immunodeficiency virus-infected children", *Clin Diagn Lab Immunol.*, 7(6):953-9 (2000).

(56) References Cited

OTHER PUBLICATIONS

Krause et al. "Epitope-Specific Human Influenza Antibody Repertoires Diversify by B Cell Intraclonal Sequence Divergence and Interclonal Convergence", *The Journal of Immunology*, 187: 3704-3711 (2011).
Kyu et al. "Frequencies of human influenza-specific antibody secreting cells or plasmablasts post vaccination from fresh and frozen peripheral blood mononuclear cells", *Journal of Immunological Methods*, 340: 42-47 (2009).
Lin, et al. "Multiplex genotype determination at a large number of gene loci", *Proc Natl Acad Sci USA*, 93(6): 2582-2587 (1996).
Mar et al. "Inferring steady state single-cell gene expression distributions from analysis of mesoscopic samples", *Genome Biology*, 7(12): R119, 12 pages (2006).
Mary et al. "Analysis of gene expression at the single-cell level using microdroplet-based microfluidic technology", *Biomicrofluidics*, 5: 024109-1-024109-10 (2011).
Mazor et al. "Antibody internalization studied using a novel IgG binding toxin fusion", *Journal of Immunological Methods*, 321: 41-59 (2007).
Mei et al. "Blood-borne human plasma cells in steady state are derived from mucosal immune responses", *Blood*, 113(11): 2461-2469 (2009).
Meijer et al. "Isolation of Human Antibody Repertoires with Preservation of the Natural Heavy and Light Chain Pairing", *J. Mol. Biol.*, 358: 764-772 (2006).
Miceli and Parnes. "The roles of CD4 and CD8 in T cell activation", *Seminars in Immunology*, 3(3): 133-141 (1991). Abstract only.
Michálek, et al. "Identification and monitoring of graft-versus-host specific T-cell clone in stem cell transplantation", *The Lancet*, 361(9364): 1183-1185 (2003).
Nie, et al. "Optical detection of single molecules", *Annu. Rev. Biophys. Biomol. Struct.*, 26: 567-596 (1997).
PCT/US2013/037258, International Search Report and Written Opinion dated Aug. 19, 2013, 8 pages.
PCT/US2013/037258, International Preliminary Report on Patentability dated Oct. 21, 2014, 6 pages.
PCT/US2014/017416, Written Opinion dated May 12, 2014, 9 pages.
PCT/US2014/017416, International Preliminary Report on Patentability dated Aug. 25, 2015, 10 pages.
PCT/US2014/030859, International Preliminary Report on Patentability mailed Sep. 15, 2015, 8 pages.
PCT/US2014/047909, Written Opinion dated Nov. 17, 2014, 9 pages.
PCT/US2015/010904, International Search Report mailed May 6, 2015.
PCT/US2015/010904, Written Opinion mailed May 6, 2015.
Plasilova et al. "Application of the Molecular Analysis of the T-Cell Receptor Repertoire in the Study of Immune-Mediated Hematologic Diseases", *Hematology*, 8(3): 173-181 (2003).
Polz and Cavanaugh. "Bias in Template-to-Product Ratios in Multitemplate PCR", *Applied and Environmental Microbiology*, 64(10): 3724-3730 (1998).
Prabakaran et al. "454 antibody sequencing—error characterization and correction", *BMC Research Notes*, 4: 404 (2011).
Qu et al. "Efficient frequency-based de novo short-read clustering for error trimming in next-generation sequencing", *Genome Research*, 19: 1309-1315 (2009).
Quick. Solid System—a next-gen DNA sequencing platform announced, Gizmag online magazine, http://www.mizmag.com/go/8248, pp. 1-5, Oct. 2007.
Quince et al. "Removing Noise From Pyrosequenced Amplicons", *BMC Informatics*, 12: 38 (2011).
Robins, et al. "CD4+ and CD8+ T cell β antigen receptors have different and predictable V and J gene usage and CDR3 lengths", *J. Immunol.*, 182: 115.10, Abstract (2012).
Robins, et al. "Effects of aging on the human adaptive immune system revealed by high-throughput DNA sequencing of T cell receptors", *J Immunol.*, 182: 47.16, Abstract (2012).
Robins, et al. "High-throughput sequencing of T-cell receptors." Sep. 2010. Poster. 1 page.
Robins, et al. "Immune profiling with high-throughput sequencing." Presented for the ASHI 2011 conference. Oct. 2011. Poster. 1 page.
Robins, et al. "Immunosequencing: applications of immune repertoire deep sequencing", *Curr Opin Immunol.*, 25(5): 646-652 (2013). doi: 10.1016/j.coi.2013.09.017. Epub Oct. 16, 2013.
Robins, et al. "Overlap of the human CD8+ T cell receptor repertoire." Oct. 2010. Poster. 1 page.
Rothberg et al. "The development and impact of 454 sequencing", *Nature Biotechnology*, 26(10): 1117-1124 (2008).
Sanchez-Freire et al. "Microfluidic single-cell real-time PCR for comparative analysis of gene expression patterns", *Nature Protocols*, 7(5): 829-838 (2012).
Sandberg, et al. "Capturing whole-genome characteristics in short sequences using a naïve Bayesian classifier", *Genome Res.*, 11(8): 1404-9 (2001).
Sequenta and iRepertoire Join Forces on Blood Cancer Testing. Business Wire. Aug. 8, 2013. http://www.businesswire.com/news/home/20 1308080053 63/en/SequentaiRepertoire-Join-Forces-Blo . . . #.VGTT9W dOyUk. 2 pages.
Sfanos et al. "Human Prostate-Infiltrating CD8+ T Lymphocytes are Oligoclonal and PD-1+", *The Prostate*, 69(15): 1694-1703 (2009).
Shendure, et al. "Advanced sequencing technologies: methods and goals", *Nat Rev Genet.*, 5(5): 335-344 (2004).
Shino, et al. "Usefulness of immune monitoring in lung transplantation using adenosine triphosphate production in activated lymphocytes", *The Journal of Heart and Lung Transplant*, 31: 996-1002 (2012).
Smith et al. "Rapid generation of fully human monoclonal antibodies specific to a vaccinating antigen", *Nature Protocols*, 4(3): 372-384 and CORRIGENDA (2009).
Smith et al. "Quantitative phenotyping via deep barcode sequencing", *Genome Research*, 19: 1836-1842 (2009).
Spreafico, et al. "A circulating reservoir of pathogenic-like CD4+ T cells shares a genetic and phenotypic signature with the inflamed synovial micro-environment", *Ann Rheum Dis.*, 0: 1-7 (2014). doi: 10.1136/annrheumdis-2014-206226. [Epub ahead of print].
Stanley. Essentials of Immunology & Serology, Delmar, Thomson Learning, Chapter 7, T cells, p. 95 (2002).
Stewart and Schwartz. "Immunoglobulin V regions and the B cell", *Blood*, 83(7): 1717-1730 (1994).
Stiller et al. "Direct multiplex sequencing (DMPS)—a novel method for targeted high-throughput sequencing of ancient and highly degraded DNA", *Genome Research*, 10: 1843-1849 (2009).
Striebich, et al. "Selective Accumulation of Related CD41 T Cell Clones in the Synovial Fluid of Patients with Rheumatoid Arthritis", *J Immunol.*, 161(8): 4428-36 (1998).
Tanaka et al. "Single-Cell Analysis of T-Cell Receptor Repertoire of HTLV-1 Tax-Specific Cytotoxic T Cells in Allogeneic Transplant Recipients with Adult T-Cell Leukemia/Lymphoma", *Cancer Research*, 70: 6181-6192 (2010).
Taubenheim et al. "High Rate of Antibody Secretion Is not Integral to Plasma Cell Differentiation as Revealed by XBP-1 Deficiency", *The Journal of Immunology*, 189: 3328-3338 (2012).
Toriello et al. "Integrated microfluidic bioprocessor for single-cell gene expression analysis", *PNAS*, 105(51): 20173-20178 (2008).
UK combined search and examination report dated Mar. 20, 2013 for GB 1300533.5.
UK Combined Search Report and Office action dated Jun. 29, 2012 for UK application No. GB1209668.1.
UK Combined Search Report and Office action dated May 27, 2011 for UK application No. GB1105068.9.
UK Search Report and office action dated Jan. 12, 2012 for UK application No. GB1120209.0.
UK Search Report and office action dated Jul. 7, 2010 for UK application No. GB1009641.0.
Vanderborght, et al. "Dynamic T cell receptor clonotype changes in synovial tissue of patients with early rheumatoid arthritis: effects of treatment with cyclosporin A (Neoral)", *J Rheumatol.*, 29(3): 416-426 (2002).

(56) References Cited

OTHER PUBLICATIONS

Wang, et al. "HIV integration site selection: Analysis by massively parallel pyrosequencing reveals association with epigenetic modifications", *Genome Research*, 17(8): 1186-1194 (2007). Epub Jun. 1, 2007.
Weinstein, J.A. et al. "High-Throughput Sequencing of the Zebrafish Antibody Repertoire", Science, 324(5928): 807-810, Supporting/Supplementary Materials (2009).
White et al. "High-throughput microfluidic single-cell RT-qPCR", *PNAS*, 108(34): 13999-14004 (2011).
Wrammert et al. "Rapid cloning of high-affinity human monoclonal antibodies against influenza virus", *Nature*, 453: 667-672 (2008).
Wu et al. "Focused Evolution of HIV-1 Neutralizing Antibodies Revealed by Structures and Deep Sequencing", *Science*, 333: 1593-1602 (2011).
Xu, et al. "Simultaneous isolation of DNA and RNA from the same cell population obtained by laser capture microdissection for genome and transcriptome profiling", *J Mol Diagn.*, 10(2):129-134 (2008). doi: 10.2353/jmoldx.2008.070131. Epub Feb. 7, 2008.
US 8,642,750, 02/2014, Faham et al. (withdrawn).
Baldauf, "Phylogeny for the faint of heart: a tutorial," Trends in Genetics, 19(6): 345-351 (2003).
Benichou, J. et al., "The restricted DH gene reading frame usage in the expressed human antibody repertoire is selected based upon its amino acid content", *J Immunol.*, 190(11): 5567-77, 29 pages. (2013).
Bradfield, et al. Graft-versus-leukemia effect in acute lymphoblastic leukemia: the importance of tumor burden and early detection. Leukemia, 18(6): 1156-1158 (2004).
Brentjens, et al. "CD19-targeted T cells rapidly induce molecular remissions in adults with chemotherapy-refractory acute lymphoblastic leukemia", Sci Transl Med., 5(177): 177ra38 (2013). doi: 10.1126/scitranslmed.3005930.
Brockman et al, "Quality scores and SNP detection in sequencing-by-synthesis systems," Genome Research, 18: 763-770 (2008).
Brownie et al. "The elimination of primer-dimer accumulation in PCR", Nucleic Acids Research, 25(16): 3235-3241 (1997).
Brüggemann, et al. "Rearranged T-cell receptor beta genes represent powerful targets for quantification of minimal residual disease in childhood and adult T-cell acute lymphoblastic leukemia", *Leukemia*, 18(4): 709-719 (2004).
Carlson, et al. "Detection of tumor tagging clones in multiple myeloma via high throughput sequencing is robust to significant levels of SHM", Presented for the 2014 ASH Annual Meeting. Poster. 1 page. Dec. 5-9, 2014.
Chen et al. "Identification of racehorse and sample contamination by novel 24-plex STR system", Forensic Science International: Genetics, 4:158-167 (2010).
Clemente, et al. "Deep sequencing of the T-cell receptor repertoire in CDS+ T-large granular lymphocyte leukemia identifies signature landscapes", Blood, 122(25): 4077-85 (2013). doi: 10.1182/blood-2013-05-506386. Epub Oct. 22, 2013.
Cooper, et al. "BRAF inhibition is associated with increased clonality in tumorinfiltrating lymphocytes", Oncoimmunology, 2(10):e26615 (2013). Epub Oct. 15, 2013.
Dahl et al. "Multiplex amplification enabled by selective circularization of large sets of genomic DNA fragments", Nucleic Acids Res., 33(8): e71 (2005).
Davila, et al. Efficacy and toxicity management of 19-28z CART cell therapy in B cell acute lymphoblastic leukemia, Sci Transl Med., 6(224):224ra25 (2014). doi: 10.1126/scitranslmed.3008226.
Delaney, et al. "Evolution and Clinical Implications of the T cell Repertoire Following Cord Blood Transplant", Biology of Blood and Marrow Transplant, vol. 19, Issue 2, S201-S202. Published Feb. 2013.
Desmarais, et al. High-throughput sequencing of memory and naïve T cell receptor repertoires at the RNA and DNA levels reveals differences in relative expression of expanded TCR clones. Apadtive Technologies. Seattle W A. Poster, 1 page. Presented May 5, 2012.

Desmarais and Robins. "High-throughput sequencing of memory and naïve T cell receptor repertoires at the RNA and DNA levels reveals differences in relative expression of expanded TCR clones", The Journal of Immunology, 188: 178.12 (2012).
Dictor et al. "Resolving T-cell receptor clonality in two and genotype in four multiplex polymerase chain reactions", *Haematologica*, 90(11): 1524-1532 (2005).
Dudgeon, et al. "The evolution of thymic lymphomas in p53 knockout mice", Genes Dev., 28(23): 2613-20 (2014). doi: 10.1101/gad.252148.114.
Eisenstein. "Personalized, sequencing-based immune profiling spurs startups", Nat Biotechnol., 31(3):184-6 (2013). doi: 10.1038/nbt0313-184b.
Emerson, et al. "Correlation of TCR diversity with immune reconstitution after cord blood transplant", Presented at the American Society of Clinical Oncology's annual meeting. May 2012. Poster. 1 page.
Emerson, et al. "CD4+ and CD8+ T cell β antigen receptors have different and predictable V and J gene usage and CDR3 lengths", Presented at the Annual Meeting of The American Association of Immunologists 2012 in Boston, MA May 2012. Poster.
Emerson, et al. "Estimating the ratio of CD4+ to CDS+ T cells using high-throughput sequence data", J Immunol Methods, 391(1-2):14-21 (2013). doi: 10.1016/j.jim.2013.02.002. Epub Feb. 18, 2013.
Emerson, et al. TCR repertoire diversity assessed with immunosequencing is associated with patient mortality following cord blood transplant. Presented for the 2014 ASH Annual Meeting. Poster. 1 page. Dec. 5-9, 2014.
Estorninho, et al. "A novel approach to tracking antigen-experienced CD4 T cells into functional compartments via tandem deep and shallow TCR clonotyping", J Immunol., 191(11): 5430-40 (2013). doi: 10.4049/jimmunol.I300622. Epub Oct. 25, 2013.
EP Application No. 09764927.1, Notice of Opposition dated Oct. 14, 2014, Reference# 547-7.
EP Application No. 09764927.1, Notice of Opposition dated Oct. 14, 2014, Reference# BR0-0001EP.
EP Application No. 09764927.1, European Opposition dated Oct. 15, 2014 (in French only).
EP Application No. 09764927.1, EPO's Communication of Notices of Opposition, dated Nov. 21, 2014.
EP Application No. 09764927.1, Patentee's Observations/Response dated May 27, 2015.
EP Application No. 09764927.1, Opponent's Response to Submission of the Patentee dated Nov. 23, 2015.
Ewing and Green, "Base-calling of automated sequencer traces using Phred. I. Accuracy Assessment," Genome Research, 8: 175-185 (1998).
Felsenstein, et al. "Evolutionary Trees from DNA Sequences: A Maximum Likelihood Approach", J Mol Evol, 17:368-376 (1981).
Flicek and Birney, "Sense from sequence reads: methods for alignment and assembly," Nature Methods Supplement, 6(11s): S6-S12 (2009).
Frederiksson et al., "Multiplex amplification of all coding sequences within 10 cancer genes by Gene-Collector", Nucleic Acids Research, 35(7): e47 (2007).
GIGA—Roche 454 FLX technology how it works. Fiche technique du Centre Interdisciplinaire de Genoproteomique Appliquee (Universite de Liege, Belgique). Accessed Oct. 15, 2014.
Gopalakrishnan, et al. "Unifying model for molecular determinants of the preselection Vβ repertoire", Proc Natl Acad Sci USA, 110(34):E3206-15 (2013). doi: 10.1073/pnas.1304048110. Epub Aug. 5, 2013.
Grupp, et al. "Chimeric antigen receptor-modified T cells for acute lymphoid leukemia", N Engl J Med., 368(16):1509-18 (2013). doi: 10.1056/NEJMoa1215134. Epub Mar. 25, 2013.
Grupp, et al. "Adoptive transfer of autologous T cells improves T-cell repertoire diversity and long-term B-cell function in pediatric patients with neuroblastoma", Clin Cancer Res., 18(24):6732-41 (2012). doi: 10.1158/1078-0432.CCR-12-1432. Epub Oct. 23, 2012.
Hathcock, et al. "ATM influences the efficiency of TCR~ rearrangement, subsequent TCRβ-dependent T cell development, and generation of the pre-selection TCRβ CDR3 repertoire", PLoS One, 8(4):e62188 (2013). doi: 10.1371/joumal.pone.0062188. Print 2013.

(56) References Cited

OTHER PUBLICATIONS

Holder and Lewis. "Phylogeny estimation: traditional and bayesian approaches. Nat Rev Genet.", 4(4): 275-84 (2009).
Illumina. Data Sheet, "TruSeq™ exome enrichment kit", 5 pages (2011).
Jones, et al. "Human autoimmunity after lymphocyte depletion is caused by homeostatic T-cell proliferation", Proc Natl Acad Sci USA, 110(50) :20200-5 (2013). doi: 10.1073/pnas.1313654110. Epub Nov. 26, 2013.
Jurkat, Clone 6-1 (ATCC TIB-152) Webpage retrievable from the ATCC under http:/ /www.lgcstandards-atcc.org/Products/ All MB-152. aspx#characteristics. Accessed Oct. 14, 2014.
Kanda, et al. "Immune recovery in adult patients after myeloablative dual umbilical cord blood, matched sibling, and matched unrelated donor hematopoietic cell transplantation", Biol Blood Marrow Transplant, 18(11):1664-1676 (2012). doi: 10.1016/j.bbmt.2012.06. 005. Epub Jun. 12, 2012.
Kirsch, et al. "Defining immunoglobulin somatic hypermutation in de novo diffuse large b-celllymphoma patients: potential application prognosis and risk stratification", Presented for the 2014 ASH Annual Meeting. Poster. 1 page. Dec. 5-9, 2014.
Kirsch, et al. "High-throughput TCR sequencing provides added value in the diagnosis of cutaneous T-cell lymphoma", Presented for the 2014 ASH Annual meeting. Poster. 1 page. Dec. 5-9, 2014.
Koboldt et al., "VarScan: variant detection in massively parallel sequencing of individual and pooled samples", Bioinformatics, 25(17): 2283-2285 (2009).
Landwehr-Kenzel, et al. "Novel GMP-compatible protocol employing an allogeneic B cell bank for clonal expansion of allospecific natural regulatory T cells", Am J Transplant., 14(3):594-606 (2014). doi: 10.1111/ajt.12629. Epub Jan. 27, 2014.
Lazareva-Ulitsky et al, "On the quality of tree-based protein classification," Bioinformatics, 21(9): 1876-1890 (2005).
Leiden, J.M. et al. "The Complete Primary Structure of the T-Cell Receptor Genes From an Alloreactive Cytotoxic Human T-Lymphocyte Clone", Immunogenetics, 24(1): 17-23 (1986).
Li et al, "Mapping short DNA sequencing reads and calling variants using mapping quality scores," Genome Research, 18: 1851-1858 (2008).
Lo, et al. T cell immunodominance is dictated by the positively selecting self-peptide, Elife, 3:e01457 (2014). doi: 10.7554/eLife. 01457. Epub Jan. 14, 2014.
Maldonado, et al. "Intramuscular therapeutic vaccination targeting HPV16 induces T cell responses that localize in mucosal lesions", Sci Transl Med., 6(221): 221ra13 (2014). doi: 10.1126/scitranslmed. 3007323.
Manion et al., "Reducing Error in Next Generation Sequencing Data with NextGENe Software's Condensation Tool™", Mar. 2009, pp. 1-3. XP055226038.
Marrero, et al. "High-throughput sequencing of islet-infiltrating memory CD4+ T cells reveals a similar pattern ofTCR Vβ usage in prediabetic and diabetic NOD mice", PLoS One, 8(10):e76546 (2013). doi: 10.1371/journal.pone.0076546. eCollection 2013.
McGoldrick, et al. "Cytomegalovirus-specific T cells are primed early after cord blood transplant but fail to control virus in vivo", Blood, 121(14): 2796-803 (2013). doi: 10.1182/blood-2012-09-453720. Epub Feb. 14, 2013.
Meier, et al. "Fractal organization of the human T cell repertoire in health and after stem cell transplantation", Biol Blood Marrow Transplant., 19(3):366-77 (2013). doi: 10.1016/j.bbmt.2012.12.004. Epub Jan. 11, 2013.
Meier et al. "Simultaneous evaluation of T-cell and B-cell clonality, t(11;14) and t(14;18), in a single reaction by a four-color multiplex polymerase chain reaction assay and automated High-Resolution fragment analysis", *American Journal of Pathology*, 159(6): 2031-2043 (2001).
Miller, et al., "Assembly algorithms for next-generation sequencing data", Genomics, 95(6): 315-327 (2010).

Mittelstadl, et al. "Thymocyte responsiveness to endogenous glucocorticoids is required for immunological fitness", J Clin Invest., 122(7):2384-94 (2012). doi: 10.1172/JCI63067. Epub Jun. 1, 2012.
Mueller, et al. "Human Treg responses allow sustained recombinant aden-associated virus-mediated transgene expression", J Clin Invest., 123(12): 5310-8 (2013). doi: 10.1172/JCI70314. Epub Nov. 15, 2013.
Muraro, et al. "T cell repertoire following autologous stem cell transplantation for multiple sclerosis", J Clin Invest., 124(3): 1168-72 (2014). doi: 10.1172/JCI71691. Epub Feb. 17, 2014.
Neller, et al. "High frequency of herpesvirus-specific clonotypes in the human T cell repertoire can remain stable over decades with minimal turnover", J Virol., 87(1): 697-700 (2013). doi: 10.1128/NI. 02180-12. Epub Oct. 17, 2012.
Nucleis product webpage, "Exonuclease I-Shrimp alkaline phosphatase clean up of PCR products," (2013) Downloaded Dec. 15, 2015.
O'Brian et al., "Sorting out mix-ups. The provenance of tissue sections may be confirmed by PCR using microsatellite markers", Am. J. Clin. Pathol., 106(6): 758-764 (1996). (Abstract Only).
Pagès, Franck. Tumor-associated immune parameters for personalized patient care. Sci Transl Med., 5(214):214fs42 (2013). doi: 10.1126/scitranslmed.3007942.
Pasqual et al. "Quantitative and qualitative changes in V-J alpha rearrangements during mouse thymocytes differentiation: implication for a limited T cell receptor alpha chain repertoire", *Journal of Experimental Medicine*, 196(9): 1163-1173 (2002). XP002322207 ISSN: 0022-1007.
Paszkiewicz et al, "De novo assembly of short sequence reads," Briefings in Bioinformatics, 11(5): 457-472 (2010).
Payne, et al. "Peripheral blood mononuclear cells of patients with breast cancer can be reprogrammed to enhance anti-HER-2/neu reactivity and overcome myeloid-derived suppressor cells", Breast Cancer Res Treat., 142(1):45-57 (2013). doi: 10.1007/s10549-013-2733-5. Epub Oct. 25, 2013.
PCT/US2013/054189, International Search Report and Written Opinion dated Oct. 21, 2013, 10 pages.
PCT/US2013/054189, International Preliminary Report on Patentability dated Feb. 10, 2015, 7 pages.
Porter, et al. "Chimeric antigen receptor-modified T cells in chronic lymphoid leukemia", N Engl J Med., 365(8):725-33 (2011). doi: 10.1056/NEJMoa1103849. Epub Aug. 10, 2011.
Putnam, et al. "Clinical grade manufacturing of human alloantigen-reactive regulatory T cells for use in transplantation", Am J Transplant., 13(11): 3010-20 (2013). doi: 10.1111/ajt.12433. Epub Sep. 18, 2013.
Ramesh, et al. "Clonal and constricted T cell repertoire in Common Variable Immune Deficiency", Clin Immunol., pii: S1521-6616(15)00004-2 (2015). doi: 10.1016/j.clim.2015.01.002. [Epub ahead of print].
Rieder, et al. "A normalization procedure for removal of residual multiplex PCR amplification bias from ultra-deep sequencing of the TCR repertoire", (Program #530W). Presented at the 62nd Annual Meeting of the American Society of Human Genetics, Nov. 7, 2012 in San Francisco, California. 2 pages.
Rieder, et al. "A normalization procedure for removal of residual multiplex PCR amplification bias from ultra-deep sequencing of the TCR repertoire", Presented at the Annual Meeting of the American Society of Hematology 2012 in Atlanta, Georgia Dec. 8-11, 2012. Poster. 1 page.
Robert, et al. "CTLA4 blockade broadens the peripheral T-cell receptor repertoire", Clin Cancer Res., 20(9):2424-32 (2014). doi: 10.1158/1078-0432.CCR-13-2648. Epub Feb. 28, 2014.
Robins. "Overlap and effective size of the human CD8+ T cell repertoire", Keystone Symposia held Oct. 27, 2010 to Nov. 1, 2010. Immunological Mechanisms of Vaccination (Abstract). Available online Sep. 27, 2010, 1 page.
Sandberg et al. "BIOMED-2 Multiplex lmmunoglobulin/T-Cell Receptor Polymerase Chain Reaction Protocols Can Reliably Replace Southern Blot Analysis in Routine Clonality Diagnostics", *J. Molecular Diagnostics*, 7(4): 495-503 (2005).
Sartorius Stedim Biotech product brochure, "Primer removal after a PCR reaction with Vivacon® 2", (2010).

(56) References Cited

OTHER PUBLICATIONS

Schloss, PD et al. Reducing the Effects of PCR Amplification and Sequencing Artifacts on 16S Rrna-Based Studies. PLoS One. Dec. 14, 2011, vol. 6, No. 12; e27310; DOI: 10.1371/journal.pone.0027310.

Sherwood, et al. "New Technologies for Measurements of Tumor Infiltrating Lymphocytes", Presented Nov. 7, 2012 Moscone Center, Exhibit Halls ABC.

Sherwood, et al. "Tumor-infiltrating lymphocytes in colorectal tumors display a diversity of T cell receptor sequences that differ from the T cells in adjacent mucosal tissue", Cancer Immunol Immunother., 62(9):1453-61 (2013). doi: 10.1007/s00262-013-1446-2. Epub Jun. 16, 2013.

Singapore Application No. 11201407888R, Written Opinion mailed Aug. 14, 2015, 12 pges.

Smith et al, "Using quality scores and longer reads improves accuracy of Solexa read mapping," BMC Bioinformatics, 9: 128 (2008).

Srivastava and Robins. "Palindromic nucleotide analysis in human T cell receptor rearrangements", PLoS One, 7(12):e52250 (2012). doi: 10.1371/journal.pone.0052250. Epub Dec. 21, 2012.

Tsai et al. "Discovery of rare mutations in populations: TILLING by sequencing", Plant Physiology, 156(3): 1257-1268 (and Supplemental Data) (2011).

Tsankova, et al. "Peripheral T-cell lymphoma emerging in a patient with aggressive polymyositis: molecular evidence for neoplastic transformation of an oligo clonal T-cell infiltrate", Acta Neuropathol., 126(4):595-601 (2013). doi: 10.1007/s00401-013-1164-z. Epub Aug. 13, 2013.

Wang et al. "Immunorepertoire analysis by multiplex PCR amplification and high throughput sequencing", Poster-Program 42.6, The 96th Annual Meeting of the America Association of Immunologists, Seattle, USA, May 8-12, 2009, 1 page.

Weng, et al. "Minimal residual disease monitoring with high-throughput sequencing of T cell receptors in cutaneous T cell lymphoma", Sci Transl Med., 5(214):214ra171 (2013). doi: 10.1126/scitranslmed.3007420.

Wu, et al. "High-throughput sequencing detects minimal residual disease in acute T lymphoblastic leukemia", Sci Transl Med., 4(134):134ra63 (2012). doi: 10.1126/scitranslmed.3003656.

Wu, et al. "High-throughput sequencing of T-cell receptor gene loci for minimal residual disease monitoring in T Lymphooblastic Leukemia", Blood, 118: 2545 (Abstr) (2011).

Zehentner et al. "Minimal Disease Detection and Confirmation in Hematologic Malignancies: Combining Cell Sorting with Clonality Profiling", *Clinical Chemistry*, 52(3): 430-437 (2006).

Zhu, et al. "Immune surveillance by CD8aa+ skin-resident T cells in human herpes virus infection", Nature, 497(7450):494-7 and Corrigendum (2013). doi: 10.1038/nature12110. Epub May 8, 2013.

| TCRB V/J SET 1 | | TCRB V/J SET 2 | | TCRB V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2989 | 2921 | 2990 | 2921 | 2991 |
| 2922 | 2990 | 2922 | 2991 | 2922 | 2992 |
| 2923 | 2991 | 2923 | 2992 | 2923 | 2993 |
| 2924 | 2992 | 2924 | 2993 | 2924 | 2994 |
| 2925 | 2993 | 2925 | 2994 | 2925 | 2995 |
| 2926 | 2994 | 2926 | 2995 | 2926 | 2996 |
| 2927 | 2995 | 2927 | 2996 | 2927 | 2997 |
| 2928 | 2996 | 2928 | 2997 | 2928 | 2998 |
| 2929 | 2997 | 2929 | 2998 | 2929 | 2999 |
| 2930 | 2998 | 2930 | 2999 | 2930 | 3000 |
| 2931 | 2999 | 2931 | 3000 | 2931 | 3001 |
| 2932 | 3000 | 2932 | 3001 | 2932 | 2989 |
| 2933 | 3001 | 2933 | 2989 | 2933 | 2990 |
| 2934 | 2989 | 2934 | 2990 | 2934 | 2991 |
| 2935 | 2990 | 2935 | 2991 | 2935 | 2992 |
| 2936 | 2991 | 2936 | 2992 | 2936 | 2993 |
| 2937 | 2992 | 2937 | 2993 | 2937 | 2994 |
| 2938 | 2993 | 2938 | 2994 | 2938 | 2995 |
| 2939 | 2994 | 2939 | 2995 | 2939 | 2996 |
| 2940 | 2995 | 2940 | 2996 | 2940 | 2997 |
| 2941 | 2996 | 2941 | 2997 | 2941 | 2998 |
| 2942 | 2997 | 2942 | 2998 | 2942 | 2999 |
| 2943 | 2998 | 2943 | 2999 | 2943 | 3000 |
| 2944 | 2999 | 2944 | 3000 | 2944 | 3001 |
| 2945 | 3000 | 2945 | 3001 | 2945 | 2989 |
| 2946 | 3001 | 2946 | 2989 | 2946 | 2990 |
| 2947 | 2989 | 2947 | 2990 | 2947 | 2991 |

Fig. 5a

| TCRB V/J SET 1 | | TCRB V/J SET 2 | | TCRB V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 2948 | 2990 | 2948 | 2991 | 2948 | 2992 |
| 2949 | 2991 | 2949 | 2992 | 2949 | 2993 |
| 2950 | 2992 | 2950 | 2993 | 2950 | 2994 |
| 2951 | 2993 | 2951 | 2994 | 2951 | 2995 |
| 2952 | 2994 | 2952 | 2995 | 2952 | 2996 |
| 2953 | 2995 | 2953 | 2996 | 2953 | 2997 |
| 2954 | 2996 | 2954 | 2997 | 2954 | 2998 |
| 2955 | 2997 | 2955 | 2998 | 2955 | 2999 |
| 2956 | 2998 | 2956 | 2999 | 2956 | 3000 |
| 2957 | 2999 | 2957 | 3000 | 2957 | 3001 |
| 2958 | 3000 | 2958 | 3001 | 2958 | 2989 |
| 2959 | 3001 | 2959 | 2989 | 2959 | 2990 |
| 2960 | 2989 | 2960 | 2990 | 2960 | 2991 |
| 2961 | 2990 | 2961 | 2991 | 2961 | 2992 |
| 2962 | 2991 | 2962 | 2992 | 2962 | 2993 |
| 2963 | 2992 | 2963 | 2993 | 2963 | 2994 |
| 2964 | 2993 | 2964 | 2994 | 2964 | 2995 |
| 2965 | 2994 | 2965 | 2995 | 2965 | 2996 |
| 2966 | 2995 | 2966 | 2996 | 2966 | 2997 |
| 2967 | 2996 | 2967 | 2997 | 2967 | 2998 |
| 2968 | 2997 | 2968 | 2998 | 2968 | 2999 |
| 2969 | 2998 | 2969 | 2999 | 2969 | 3000 |
| 2970 | 2999 | 2970 | 3000 | 2970 | 3001 |
| 2971 | 3000 | 2971 | 3001 | 2971 | 2989 |
| 2972 | 3001 | 2972 | 2989 | 2972 | 2990 |
| 2973 | 2989 | 2973 | 2990 | 2973 | 2991 |
| 2974 | 2990 | 2974 | 2991 | 2974 | 2992 |
| 2975 | 2991 | 2975 | 2992 | 2975 | 2993 |
| 2976 | 2992 | 2976 | 2993 | 2976 | 2994 |
| 2977 | 2993 | 2977 | 2994 | 2977 | 2995 |
| 2978 | 2994 | 2978 | 2995 | 2978 | 2996 |

Fig. 5b

| TCRB V/J SET 1 | |
|---|---|
| SEQ ID NO:V | SEQ ID NO:J |
| 2979 | 2995 |
| 2980 | 2996 |
| 2981 | 2997 |
| 2982 | 2998 |
| 2983 | 2999 |
| 2984 | 3000 |
| 2985 | 3001 |
| 2986 | 2989 |
| 2987 | 2990 |
| 2988 | 2991 |

| TCRB V/J SET 2 | |
|---|---|
| SEQ ID NO:V | SEQ ID NO:J |
| 2979 | 2996 |
| 2980 | 2997 |
| 2981 | 2998 |
| 2982 | 2999 |
| 2983 | 3000 |
| 2984 | 3001 |
| 2985 | 2989 |
| 2986 | 2990 |
| 2987 | 2991 |
| 2988 | 2992 |

| TCRB V/J SET 3 | |
|---|---|
| SEQ ID NO:V | SEQ ID NO:J |
| 2979 | 2997 |
| 2980 | 2998 |
| 2981 | 2999 |
| 2982 | 3000 |
| 2983 | 3001 |
| 2984 | 2989 |
| 2985 | 2990 |
| 2986 | 2991 |
| 2987 | 2992 |
| 2988 | 2993 |

| TCRB V/J SET 4 | |
|---|---|
| SEQ ID NO:V | SEQ ID NO:J |
| 2921 | 2992 |
| 2922 | 2993 |
| 2923 | 2994 |
| 2924 | 2995 |
| 2925 | 2996 |
| 2926 | 2997 |
| 2927 | 2998 |
| 2928 | 2999 |
| 2929 | 3000 |
| 2930 | 3001 |
| 2931 | 2989 |
| 2932 | 2990 |
| 2933 | 2991 |
| 2934 | 2992 |
| 2935 | 2993 |
| 2936 | 2994 |
| 2937 | 2995 |

| TCRB V/J SET 5 | |
|---|---|
| SEQ ID NO:V | SEQ ID NO:J |
| 2921 | 2993 |
| 2922 | 2994 |
| 2923 | 2995 |
| 2924 | 2996 |
| 2925 | 2997 |
| 2926 | 2998 |
| 2927 | 2999 |
| 2928 | 3000 |
| 2929 | 3001 |
| 2930 | 2989 |
| 2931 | 2990 |
| 2932 | 2991 |
| 2933 | 2992 |
| 2934 | 2993 |
| 2935 | 2994 |
| 2936 | 2995 |
| 2937 | 2996 |

| TCRB V/J SET 6 | |
|---|---|
| SEQ ID NO:V | SEQ ID NO:J |
| 2921 | 2994 |
| 2922 | 2995 |
| 2923 | 2996 |
| 2924 | 2997 |
| 2925 | 2998 |
| 2926 | 2999 |
| 2927 | 3000 |
| 2928 | 3001 |
| 2929 | 2989 |
| 2930 | 2990 |
| 2931 | 2991 |
| 2932 | 2992 |
| 2933 | 2993 |
| 2934 | 2994 |
| 2935 | 2995 |
| 2936 | 2996 |
| 2937 | 2997 |

Fig. 5c

| TCRB V/J SET 4 | | TCRB V/J SET 5 | | TCRB V/J SET 6 | |
|---|---|---|---|---|---|
| SEQ ID NO:V | SEQ ID NO:J | SEQ ID NO:V | SEQ ID NO:J | SEQ ID NO:V | SEQ ID NO:J |
| 2938 | 2996 | 2938 | 2997 | 2938 | 2998 |
| 2939 | 2997 | 2939 | 2998 | 2939 | 2999 |
| 2940 | 2998 | 2940 | 2999 | 2940 | 3000 |
| 2941 | 2999 | 2941 | 3000 | 2941 | 3001 |
| 2942 | 3000 | 2942 | 3001 | 2942 | 2989 |
| 2943 | 3001 | 2943 | 2989 | 2943 | 2990 |
| 2944 | 2989 | 2944 | 2990 | 2944 | 2991 |
| 2945 | 2990 | 2945 | 2991 | 2945 | 2992 |
| 2946 | 2991 | 2946 | 2992 | 2946 | 2993 |
| 2947 | 2992 | 2947 | 2993 | 2947 | 2994 |
| 2948 | 2993 | 2948 | 2994 | 2948 | 2995 |
| 2949 | 2994 | 2949 | 2995 | 2949 | 2996 |
| 2950 | 2995 | 2950 | 2996 | 2950 | 2997 |
| 2951 | 2996 | 2951 | 2997 | 2951 | 2998 |
| 2952 | 2997 | 2952 | 2998 | 2952 | 2999 |
| 2953 | 2998 | 2953 | 2999 | 2953 | 3000 |
| 2954 | 2999 | 2954 | 3000 | 2954 | 3001 |
| 2955 | 3000 | 2955 | 3001 | 2955 | 2989 |
| 2956 | 3001 | 2956 | 2989 | 2956 | 2990 |
| 2957 | 2989 | 2957 | 2990 | 2957 | 2991 |
| 2958 | 2990 | 2958 | 2991 | 2958 | 2992 |
| 2959 | 2991 | 2959 | 2992 | 2959 | 2993 |
| 2960 | 2992 | 2960 | 2993 | 2960 | 2994 |
| 2961 | 2993 | 2961 | 2994 | 2961 | 2995 |
| 2962 | 2994 | 2962 | 2995 | 2962 | 2996 |
| 2963 | 2995 | 2963 | 2996 | 2963 | 2997 |
| 2964 | 2996 | 2964 | 2997 | 2964 | 2998 |
| 2965 | 2997 | 2965 | 2998 | 2965 | 2999 |
| 2966 | 2998 | 2966 | 2999 | 2966 | 3000 |
| 2967 | 2999 | 2967 | 3000 | 2967 | 3001 |
| 2968 | 3000 | 2968 | 3001 | 2968 | 2989 |

Fig. 5d

| TCRB V/J SET 4 | | TCRB V/J SET 5 | | TCRB V/J SET 6 | |
|---|---|---|---|---|---|
| SEQ ID NO:V | SEQ ID NO:J | SEQ ID NO:V | SEQ ID NO:J | SEQ ID NO:V | SEQ ID NO:J |
| 2969 | 3001 | 2969 | 2989 | 2969 | 2990 |
| 2970 | 2989 | 2970 | 2990 | 2970 | 2991 |
| 2971 | 2990 | 2971 | 2991 | 2971 | 2992 |
| 2972 | 2991 | 2972 | 2992 | 2972 | 2993 |
| 2973 | 2992 | 2973 | 2993 | 2973 | 2994 |
| 2974 | 2993 | 2974 | 2994 | 2974 | 2995 |
| 2975 | 2994 | 2975 | 2995 | 2975 | 2996 |
| 2976 | 2995 | 2976 | 2996 | 2976 | 2997 |
| 2977 | 2996 | 2977 | 2997 | 2977 | 2998 |
| 2978 | 2997 | 2978 | 2998 | 2978 | 2999 |
| 2979 | 2998 | 2979 | 2999 | 2979 | 3000 |
| 2980 | 2999 | 2980 | 3000 | 2980 | 3001 |
| 2981 | 3000 | 2981 | 3001 | 2981 | 2989 |
| 2982 | 3001 | 2982 | 2989 | 2982 | 2990 |
| 2983 | 2989 | 2983 | 2990 | 2983 | 2991 |
| 2984 | 2990 | 2984 | 2991 | 2984 | 2992 |
| 2985 | 2991 | 2985 | 2992 | 2985 | 2993 |
| 2986 | 2992 | 2986 | 2993 | 2986 | 2994 |
| 2987 | 2993 | 2987 | 2994 | 2987 | 2995 |
| 2988 | 2994 | 2988 | 2995 | 2988 | 2996 |

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2995 | 2921 | 2996 | 2921 | 2997 |
| 2922 | 2996 | 2922 | 2997 | 2922 | 2998 |
| 2923 | 2997 | 2923 | 2998 | 2923 | 2999 |
| 2924 | 2998 | 2924 | 2999 | 2924 | 3000 |
| 2925 | 2999 | 2925 | 3000 | 2925 | 3001 |
| 2926 | 3000 | 2926 | 3001 | 2926 | 2989 |
| 2927 | 3001 | 2927 | 2989 | 2927 | 2990 |

Fig. 5e

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2928 | 2989 | 2928 | 2990 | 2928 | 2991 |
| 2929 | 2990 | 2929 | 2991 | 2929 | 2992 |
| 2930 | 2991 | 2930 | 2992 | 2930 | 2993 |
| 2931 | 2992 | 2931 | 2993 | 2931 | 2994 |
| 2932 | 2993 | 2932 | 2994 | 2932 | 2995 |
| 2933 | 2994 | 2933 | 2995 | 2933 | 2996 |
| 2934 | 2995 | 2934 | 2996 | 2934 | 2997 |
| 2935 | 2996 | 2935 | 2997 | 2935 | 2998 |
| 2936 | 2997 | 2936 | 2998 | 2936 | 2999 |
| 2937 | 2998 | 2937 | 2999 | 2937 | 3000 |
| 2938 | 2999 | 2938 | 3000 | 2938 | 3001 |
| 2939 | 3000 | 2939 | 3001 | 2939 | 2989 |
| 2940 | 3001 | 2940 | 2989 | 2940 | 2990 |
| 2941 | 2989 | 2941 | 2990 | 2941 | 2991 |
| 2942 | 2990 | 2942 | 2991 | 2942 | 2992 |
| 2943 | 2991 | 2943 | 2992 | 2943 | 2993 |
| 2944 | 2992 | 2944 | 2993 | 2944 | 2994 |
| 2945 | 2993 | 2945 | 2994 | 2945 | 2995 |
| 2946 | 2994 | 2946 | 2995 | 2946 | 2996 |
| 2947 | 2995 | 2947 | 2996 | 2947 | 2997 |
| 2948 | 2996 | 2948 | 2997 | 2948 | 2998 |
| 2949 | 2997 | 2949 | 2998 | 2949 | 2999 |
| 2950 | 2998 | 2950 | 2999 | 2950 | 3000 |
| 2951 | 2999 | 2951 | 3000 | 2951 | 3001 |
| 2952 | 3000 | 2952 | 3001 | 2952 | 2989 |
| 2953 | 3001 | 2953 | 2989 | 2953 | 2990 |
| 2954 | 2989 | 2954 | 2990 | 2954 | 2991 |
| 2955 | 2990 | 2955 | 2991 | 2955 | 2992 |
| 2956 | 2991 | 2956 | 2992 | 2956 | 2993 |
| 2957 | 2992 | 2957 | 2993 | 2957 | 2994 |
| 2958 | 2993 | 2958 | 2994 | 2958 | 2995 |

Fig. 5f

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2959 | 2994 | 2959 | 2995 | 2959 | 2996 |
| 2960 | 2995 | 2960 | 2996 | 2960 | 2997 |
| 2961 | 2996 | 2961 | 2997 | 2961 | 2998 |
| 2962 | 2997 | 2962 | 2998 | 2962 | 2999 |
| 2963 | 2998 | 2963 | 2999 | 2963 | 3000 |
| 2964 | 2999 | 2964 | 3000 | 2964 | 3001 |
| 2965 | 3000 | 2965 | 3001 | 2965 | 2989 |
| 2966 | 3001 | 2966 | 2989 | 2966 | 2990 |
| 2967 | 2989 | 2967 | 2990 | 2967 | 2991 |
| 2968 | 2990 | 2968 | 2991 | 2968 | 2992 |
| 2969 | 2991 | 2969 | 2992 | 2969 | 2993 |
| 2970 | 2992 | 2970 | 2993 | 2970 | 2994 |
| 2971 | 2993 | 2971 | 2994 | 2971 | 2995 |
| 2972 | 2994 | 2972 | 2995 | 2972 | 2996 |
| 2973 | 2995 | 2973 | 2996 | 2973 | 2997 |
| 2974 | 2996 | 2974 | 2997 | 2974 | 2998 |
| 2975 | 2997 | 2975 | 2998 | 2975 | 2999 |
| 2976 | 2998 | 2976 | 2999 | 2976 | 3000 |
| 2977 | 2999 | 2977 | 3000 | 2977 | 3001 |
| 2978 | 3000 | 2978 | 3001 | 2978 | 2989 |
| 2979 | 3001 | 2979 | 2989 | 2979 | 2990 |
| 2980 | 2989 | 2980 | 2990 | 2980 | 2991 |
| 2981 | 2990 | 2981 | 2991 | 2981 | 2992 |
| 2982 | 2991 | 2982 | 2992 | 2982 | 2993 |
| 2983 | 2992 | 2983 | 2993 | 2983 | 2994 |
| 2984 | 2993 | 2984 | 2994 | 2984 | 2995 |
| 2985 | 2994 | 2985 | 2995 | 2985 | 2996 |
| 2986 | 2995 | 2986 | 2996 | 2986 | 2997 |
| 2987 | 2996 | 2987 | 2997 | 2987 | 2998 |
| 2988 | 2997 | 2988 | 2998 | 2988 | 2999 |

Fig. 5g

| TCRB V/J SET 10 | | TCRB V/J SET 11 | | TCRB V/J SET 12 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2998 | 2921 | 2999 | 2921 | 3000 |
| 2922 | 2999 | 2922 | 3000 | 2922 | 3001 |
| 2923 | 3000 | 2923 | 3001 | 2923 | 2989 |
| 2924 | 3001 | 2924 | 2989 | 2924 | 2990 |
| 2925 | 2989 | 2925 | 2990 | 2925 | 2991 |
| 2926 | 2990 | 2926 | 2991 | 2926 | 2992 |
| 2927 | 2991 | 2927 | 2992 | 2927 | 2993 |
| 2928 | 2992 | 2928 | 2993 | 2928 | 2994 |
| 2929 | 2993 | 2929 | 2994 | 2929 | 2995 |
| 2930 | 2994 | 2930 | 2995 | 2930 | 2996 |
| 2931 | 2995 | 2931 | 2996 | 2931 | 2997 |
| 2932 | 2996 | 2932 | 2997 | 2932 | 2998 |
| 2933 | 2997 | 2933 | 2998 | 2933 | 2999 |
| 2934 | 2998 | 2934 | 2999 | 2934 | 3000 |
| 2935 | 2999 | 2935 | 3000 | 2935 | 3001 |
| 2936 | 3000 | 2936 | 3001 | 2936 | 2989 |
| 2937 | 3001 | 2937 | 2989 | 2937 | 2990 |
| 2938 | 2989 | 2938 | 2990 | 2938 | 2991 |
| 2939 | 2990 | 2939 | 2991 | 2939 | 2992 |
| 2940 | 2991 | 2940 | 2992 | 2940 | 2993 |
| 2941 | 2992 | 2941 | 2993 | 2941 | 2994 |
| 2942 | 2993 | 2942 | 2994 | 2942 | 2995 |
| 2943 | 2994 | 2943 | 2995 | 2943 | 2996 |
| 2944 | 2995 | 2944 | 2996 | 2944 | 2997 |
| 2945 | 2996 | 2945 | 2997 | 2945 | 2998 |
| 2946 | 2997 | 2946 | 2998 | 2946 | 2999 |
| 2947 | 2998 | 2947 | 2999 | 2947 | 3000 |
| 2948 | 2999 | 2948 | 3000 | 2948 | 3001 |
| 2949 | 3000 | 2949 | 3001 | 2949 | 2989 |
| 2950 | 3001 | 2950 | 2989 | 2950 | 2990 |

Fig. 5h

| TCRB V/J SET 10 | | TCRB V/J SET 11 | | TCRB V/J SET 12 | |
|---|---|---|---|---|---|
| SEQ ID NO:V | SEQ ID NO:J | SEQ ID NO:V | SEQ ID NO:J | SEQ ID NO:V | SEQ ID NO:J |
| 2951 | 2989 | 2951 | 2990 | 2951 | 2991 |
| 2952 | 2990 | 2952 | 2991 | 2952 | 2992 |
| 2953 | 2991 | 2953 | 2992 | 2953 | 2993 |
| 2954 | 2992 | 2954 | 2993 | 2954 | 2994 |
| 2955 | 2993 | 2955 | 2994 | 2955 | 2995 |
| 2956 | 2994 | 2956 | 2995 | 2956 | 2996 |
| 2957 | 2995 | 2957 | 2996 | 2957 | 2997 |
| 2958 | 2996 | 2958 | 2997 | 2958 | 2998 |
| 2959 | 2997 | 2959 | 2998 | 2959 | 2999 |
| 2960 | 2998 | 2960 | 2999 | 2960 | 3000 |
| 2961 | 2999 | 2961 | 3000 | 2961 | 3001 |
| 2962 | 3000 | 2962 | 3001 | 2962 | 2989 |
| 2963 | 3001 | 2963 | 2989 | 2963 | 2990 |
| 2964 | 2989 | 2964 | 2990 | 2964 | 2991 |
| 2965 | 2990 | 2965 | 2991 | 2965 | 2992 |
| 2966 | 2991 | 2966 | 2992 | 2966 | 2993 |
| 2967 | 2992 | 2967 | 2993 | 2967 | 2994 |
| 2968 | 2993 | 2968 | 2994 | 2968 | 2995 |
| 2969 | 2994 | 2969 | 2995 | 2969 | 2996 |
| 2970 | 2995 | 2970 | 2996 | 2970 | 2997 |
| 2971 | 2996 | 2971 | 2997 | 2971 | 2998 |
| 2972 | 2997 | 2972 | 2998 | 2972 | 2999 |
| 2973 | 2998 | 2973 | 2999 | 2973 | 3000 |
| 2974 | 2999 | 2974 | 3000 | 2974 | 3001 |
| 2975 | 3000 | 2975 | 3001 | 2975 | 2989 |
| 2976 | 3001 | 2976 | 2989 | 2976 | 2990 |
| 2977 | 2989 | 2977 | 2990 | 2977 | 2991 |
| 2978 | 2990 | 2978 | 2991 | 2978 | 2992 |
| 2979 | 2991 | 2979 | 2992 | 2979 | 2993 |
| 2980 | 2992 | 2980 | 2993 | 2980 | 2994 |
| 2981 | 2993 | 2981 | 2994 | 2981 | 2995 |

Fig. 5i

| TCRB V/J SET 10 | |
|---|---|
| SEQ ID NO:V | SEQ ID NO:J |
| 2982 | 2994 |
| 2983 | 2995 |
| 2984 | 2996 |
| 2985 | 2997 |
| 2986 | 2998 |
| 2987 | 2999 |
| 2988 | 3000 |

| TCRB V/J SET 11 | | TCRB V/J SET 12 | |
|---|---|---|---|
| SEQ ID NO:V | SEQ ID NO:J | SEQ ID NO:V | SEQ ID NO:J |
| 2982 | 2995 | 2982 | 2996 |
| 2983 | 2996 | 2983 | 2997 |
| 2984 | 2997 | 2984 | 2998 |
| 2985 | 2998 | 2985 | 2999 |
| 2986 | 2999 | 2986 | 3000 |
| 2987 | 3000 | 2987 | 3001 |
| 2988 | 3001 | 2988 | 2989 |

| TCRB V/J SET 13 | |
|---|---|
| SEQ ID NO:V | SEQ ID NO:J |
| 2921 | 3001 |
| 2922 | 2989 |
| 2923 | 2990 |
| 2924 | 2991 |
| 2925 | 2992 |
| 2926 | 2993 |
| 2927 | 2994 |
| 2928 | 2995 |
| 2929 | 2996 |
| 2930 | 2997 |
| 2931 | 2998 |
| 2932 | 2999 |
| 2933 | 3000 |
| 2934 | 3001 |
| 2935 | 2989 |
| 2936 | 2990 |
| 2937 | 2991 |
| 2938 | 2992 |
| 2939 | 2993 |
| 2940 | 2994 |

Fig. 5j

| TCRB V/J SET 13 | |
|---|---|
| SEQ ID NO:V | SEQ ID NO:J |
| 2941 | 2995 |
| 2942 | 2996 |
| 2943 | 2997 |
| 2944 | 2998 |
| 2945 | 2999 |
| 2946 | 3000 |
| 2947 | 3001 |
| 2948 | 2989 |
| 2949 | 2990 |
| 2950 | 2991 |
| 2951 | 2992 |
| 2952 | 2993 |
| 2953 | 2994 |
| 2954 | 2995 |
| 2955 | 2996 |
| 2956 | 2997 |
| 2957 | 2998 |
| 2958 | 2999 |
| 2959 | 3000 |
| 2960 | 3001 |
| 2961 | 2989 |
| 2962 | 2990 |
| 2963 | 2991 |
| 2964 | 2992 |
| 2965 | 2993 |
| 2966 | 2994 |
| 2967 | 2995 |
| 2968 | 2996 |
| 2969 | 2997 |
| 2970 | 2998 |
| 2971 | 2999 |

Fig. 5k

| TCRB V/J SET 13 | |
|---|---|
| SEQ ID NO:V | SEQ ID NO:J |
| 2972 | 3030 |
| 2973 | 3031 |
| 2974 | 2989 |
| 2975 | 2990 |
| 2976 | 2991 |
| 2977 | 2992 |
| 2978 | 2993 |
| 2979 | 2994 |
| 2980 | 2995 |
| 2981 | 2996 |
| 2982 | 2997 |
| 2983 | 2998 |
| 2984 | 2999 |
| 2985 | 3030 |
| 2986 | 3031 |
| 2987 | 2989 |
| 2988 | 2990 |

Fig. 5I

| TCRG V/J SET 1 | | TCRG V/J SET 2 | | TCRG V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 3002 | 3016 | 3002 | 3017 | 3002 | 3018 |
| 3003 | 3017 | 3003 | 3018 | 3003 | 3019 |
| 3004 | 3018 | 3004 | 3019 | 3004 | 3020 |
| 3005 | 3019 | 3005 | 3020 | 3005 | 3016 |
| 3006 | 3020 | 3006 | 3016 | 3006 | 3017 |
| 3007 | 3016 | 3007 | 3017 | 3007 | 3018 |
| 3008 | 3017 | 3008 | 3018 | 3008 | 3019 |
| 3009 | 3018 | 3009 | 3019 | 3009 | 3020 |
| 3010 | 3019 | 3010 | 3020 | 3010 | 3016 |
| 3011 | 3020 | 3011 | 3016 | 3011 | 3017 |
| 3012 | 3016 | 3012 | 3017 | 3012 | 3018 |
| 3013 | 3017 | 3013 | 3018 | 3013 | 3019 |
| 3014 | 3018 | 3014 | 3019 | 3014 | 3020 |
| 3015 | 3019 | 3015 | 3020 | 3015 | 3016 |

| TCRG V/J SET 4 | | TCRG V/J SET 5 | |
|---|---|---|---|
| SEQ ID NO:V | SEQ ID NO:J | SEQ ID NO:V | SEQ ID NO:J |
| 3002 | 3019 | 3002 | 3020 |
| 3003 | 3020 | 3003 | 3016 |
| 3004 | 3016 | 3004 | 3017 |
| 3005 | 3017 | 3005 | 3018 |
| 3006 | 3018 | 3006 | 3019 |
| 3007 | 3019 | 3007 | 3020 |
| 3008 | 3020 | 3008 | 3016 |
| 3009 | 3016 | 3009 | 3017 |

Fig. 6a

| TCRG V/J SET 4 | | TCRG V/J SET 5 | |
|---|---|---|---|
| SEQ ID NO:V | SEQ ID NO:J | SEQ ID NO:V | SEQ ID NO:J |
| 3010 | 3017 | 3010 | 3018 |
| 3011 | 3018 | 3011 | 3019 |
| 3012 | 3019 | 3012 | 3020 |
| 3013 | 3020 | 3013 | 3016 |
| 3014 | 3016 | 3014 | 3017 |
| 3015 | 3017 | 3015 | 3018 |

Fig. 6b

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3021 | 3148 | 3021 | 3149 | 3021 | 3150 |
| 3022 | 3149 | 3022 | 3150 | 3022 | 3151 |
| 3023 | 3150 | 3023 | 3151 | 3023 | 3152 |
| 3024 | 3151 | 3024 | 3152 | 3024 | 3153 |
| 3025 | 3152 | 3025 | 3153 | 3025 | 3154 |
| 3026 | 3153 | 3026 | 3154 | 3026 | 3155 |
| 3027 | 3154 | 3027 | 3155 | 3027 | 3156 |
| 3028 | 3155 | 3028 | 3156 | 3028 | 3148 |
| 3029 | 3156 | 3029 | 3148 | 3029 | 3149 |
| 3030 | 3148 | 3030 | 3149 | 3030 | 3150 |
| 3031 | 3149 | 3031 | 3150 | 3031 | 3151 |
| 3032 | 3150 | 3032 | 3151 | 3032 | 3152 |
| 3033 | 3151 | 3033 | 3152 | 3033 | 3153 |
| 3034 | 3152 | 3034 | 3153 | 3034 | 3154 |
| 3035 | 3153 | 3035 | 3154 | 3035 | 3155 |
| 3036 | 3154 | 3036 | 3155 | 3036 | 3156 |
| 3037 | 3155 | 3037 | 3156 | 3037 | 3148 |
| 3038 | 3156 | 3038 | 3148 | 3038 | 3149 |
| 3039 | 3148 | 3039 | 3149 | 3039 | 3150 |
| 3040 | 3149 | 3040 | 3150 | 3040 | 3151 |
| 3041 | 3150 | 3041 | 3151 | 3041 | 3152 |
| 3042 | 3151 | 3042 | 3152 | 3042 | 3153 |
| 3043 | 3152 | 3043 | 3153 | 3043 | 3154 |
| 3044 | 3153 | 3044 | 3154 | 3044 | 3155 |
| 3045 | 3154 | 3045 | 3155 | 3045 | 3156 |
| 3046 | 3155 | 3046 | 3156 | 3046 | 3148 |
| 3047 | 3156 | 3047 | 3148 | 3047 | 3149 |

Fig. 7a

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3048 | 3148 | 3048 | 3149 | 3048 | 3150 |
| 3049 | 3149 | 3049 | 3150 | 3049 | 3151 |
| 3050 | 3150 | 3050 | 3151 | 3050 | 3152 |
| 3051 | 3151 | 3051 | 3152 | 3051 | 3153 |
| 3052 | 3152 | 3052 | 3153 | 3052 | 3154 |
| 3053 | 3153 | 3053 | 3154 | 3053 | 3155 |
| 3054 | 3154 | 3054 | 3155 | 3054 | 3156 |
| 3055 | 3155 | 3055 | 3156 | 3055 | 3148 |
| 3056 | 3156 | 3056 | 3148 | 3056 | 3149 |
| 3057 | 3148 | 3057 | 3149 | 3057 | 3150 |
| 3058 | 3149 | 3058 | 3150 | 3058 | 3151 |
| 3059 | 3150 | 3059 | 3151 | 3059 | 3152 |
| 3060 | 3151 | 3060 | 3152 | 3060 | 3153 |
| 3061 | 3152 | 3061 | 3153 | 3061 | 3154 |
| 3062 | 3153 | 3062 | 3154 | 3062 | 3155 |
| 3063 | 3154 | 3063 | 3155 | 3063 | 3156 |
| 3064 | 3155 | 3064 | 3156 | 3064 | 3148 |
| 3065 | 3156 | 3065 | 3148 | 3065 | 3149 |
| 3066 | 3148 | 3066 | 3149 | 3066 | 3150 |
| 3067 | 3149 | 3067 | 3150 | 3067 | 3151 |
| 3068 | 3150 | 3068 | 3151 | 3068 | 3152 |
| 3069 | 3151 | 3069 | 3152 | 3069 | 3153 |
| 3070 | 3152 | 3070 | 3153 | 3070 | 3154 |
| 3071 | 3153 | 3071 | 3154 | 3071 | 3155 |
| 3072 | 3154 | 3072 | 3155 | 3072 | 3156 |
| 3073 | 3155 | 3073 | 3156 | 3073 | 3148 |
| 3074 | 3156 | 3074 | 3148 | 3074 | 3149 |
| 3075 | 3148 | 3075 | 3149 | 3075 | 3150 |
| 3076 | 3149 | 3076 | 3150 | 3076 | 3151 |
| 3077 | 3150 | 3077 | 3151 | 3077 | 3152 |
| 3078 | 3151 | 3078 | 3152 | 3078 | 3153 |

Fig. 7b

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3079 | 3152 | 3079 | 3153 | 3079 | 3154 |
| 3080 | 3153 | 3080 | 3154 | 3080 | 3155 |
| 3081 | 3154 | 3081 | 3155 | 3081 | 3156 |
| 3082 | 3155 | 3082 | 3156 | 3082 | 3148 |
| 3083 | 3156 | 3083 | 3148 | 3083 | 3149 |
| 3084 | 3148 | 3084 | 3149 | 3084 | 3150 |
| 3085 | 3149 | 3085 | 3150 | 3085 | 3151 |
| 3086 | 3150 | 3086 | 3151 | 3086 | 3152 |
| 3087 | 3151 | 3087 | 3152 | 3087 | 3153 |
| 3088 | 3152 | 3088 | 3153 | 3088 | 3154 |
| 3089 | 3153 | 3089 | 3154 | 3089 | 3155 |
| 3090 | 3154 | 3090 | 3155 | 3090 | 3156 |
| 3091 | 3155 | 3091 | 3156 | 3091 | 3148 |
| 3092 | 3156 | 3092 | 3148 | 3092 | 3149 |
| 3093 | 3148 | 3093 | 3149 | 3093 | 3150 |
| 3094 | 3149 | 3094 | 3150 | 3094 | 3151 |
| 3095 | 3150 | 3095 | 3151 | 3095 | 3152 |
| 3096 | 3151 | 3096 | 3152 | 3096 | 3153 |
| 3097 | 3152 | 3097 | 3153 | 3097 | 3154 |
| 3098 | 3153 | 3098 | 3154 | 3098 | 3155 |
| 3099 | 3154 | 3099 | 3155 | 3099 | 3156 |
| 3100 | 3155 | 3100 | 3156 | 3100 | 3148 |
| 3101 | 3156 | 3101 | 3148 | 3101 | 3149 |
| 3102 | 3148 | 3102 | 3149 | 3102 | 3150 |
| 3103 | 3149 | 3103 | 3150 | 3103 | 3151 |
| 3104 | 3150 | 3104 | 3151 | 3104 | 3152 |
| 3105 | 3151 | 3105 | 3152 | 3105 | 3153 |
| 3106 | 3152 | 3106 | 3153 | 3106 | 3154 |
| 3107 | 3153 | 3107 | 3154 | 3107 | 3155 |
| 3108 | 3154 | 3108 | 3155 | 3108 | 3156 |
| 3109 | 3155 | 3109 | 3156 | 3109 | 3148 |

Fig. 7c

| IGH V/J SET 1 | | IGH V/J SET 2 | | IGH V/J SET 3 | |
|---|---|---|---|---|---|
| SEQ ID NO: V | SEQ ID NO: J | SEQ ID NO: V | SEQ ID NO: J | SEQ ID NO: V | SEQ ID NO: J |
| 3110 | 3156 | 3110 | 3148 | 3110 | 3149 |
| 3111 | 3148 | 3111 | 3149 | 3111 | 3150 |
| 3112 | 3149 | 3112 | 3150 | 3112 | 3151 |
| 3113 | 3150 | 3113 | 3151 | 3113 | 3152 |
| 3114 | 3151 | 3114 | 3152 | 3114 | 3153 |
| 3115 | 3152 | 3115 | 3153 | 3115 | 3154 |
| 3116 | 3153 | 3116 | 3154 | 3116 | 3155 |
| 3117 | 3154 | 3117 | 3155 | 3117 | 3156 |
| 3118 | 3155 | 3118 | 3156 | 3118 | 3148 |
| 3119 | 3156 | 3119 | 3148 | 3119 | 3149 |
| 3120 | 3148 | 3120 | 3149 | 3120 | 3150 |
| 3121 | 3149 | 3121 | 3150 | 3121 | 3151 |
| 3122 | 3150 | 3122 | 3151 | 3122 | 3152 |
| 3123 | 3151 | 3123 | 3152 | 3123 | 3153 |
| 3124 | 3152 | 3124 | 3153 | 3124 | 3154 |
| 3125 | 3153 | 3125 | 3154 | 3125 | 3155 |
| 3126 | 3154 | 3126 | 3155 | 3126 | 3156 |
| 3127 | 3155 | 3127 | 3156 | 3127 | 3148 |
| 3128 | 3156 | 3128 | 3148 | 3128 | 3149 |
| 3129 | 3148 | 3129 | 3149 | 3129 | 3150 |
| 3130 | 3149 | 3130 | 3150 | 3130 | 3151 |
| 3131 | 3150 | 3131 | 3151 | 3131 | 3152 |
| 3132 | 3151 | 3132 | 3152 | 3132 | 3153 |
| 3133 | 3152 | 3133 | 3153 | 3133 | 3154 |
| 3134 | 3153 | 3134 | 3154 | 3134 | 3155 |
| 3135 | 3154 | 3135 | 3155 | 3135 | 3156 |
| 3136 | 3155 | 3136 | 3156 | 3136 | 3148 |
| 3137 | 3156 | 3137 | 3148 | 3137 | 3149 |
| 3138 | 3148 | 3138 | 3149 | 3138 | 3150 |
| 3139 | 3149 | 3139 | 3150 | 3139 | 3151 |
| 3140 | 3150 | 3140 | 3151 | 3140 | 3152 |

Fig. 7d

| IGH V/J SET 1 | |
|---|---|
| SEQ ID NO: V | SEQ ID NO: J |
| 3141 | 3151 |
| 3142 | 3152 |
| 3143 | 3153 |
| 3144 | 3154 |
| 3145 | 3155 |
| 3146 | 3156 |
| 3147 | 3148 |

| IGH V/J SET 2 | |
|---|---|
| SEQ ID NO: V | SEQ ID NO: J |
| 3141 | 3152 |
| 3142 | 3153 |
| 3143 | 3154 |
| 3144 | 3155 |
| 3145 | 3156 |
| 3146 | 3148 |
| 3147 | 3149 |

| IGH V/J SET 3 | |
|---|---|
| SEQ ID NO: V | SEQ ID NO: J |
| 3141 | 3153 |
| 3142 | 3154 |
| 3143 | 3155 |
| 3144 | 3156 |
| 3145 | 3148 |
| 3146 | 3149 |
| 3147 | 3150 |

| IGH V/J SET 4 | |
|---|---|
| SEQ ID NO: V | SEQ ID NO: J |
| 3021 | 3151 |
| 3022 | 3152 |
| 3023 | 3153 |
| 3024 | 3154 |
| 3025 | 3155 |
| 3026 | 3156 |
| 3027 | 3148 |
| 3028 | 3149 |
| 3029 | 3150 |
| 3030 | 3151 |
| 3031 | 3152 |
| 3032 | 3153 |
| 3033 | 3154 |
| 3034 | 3155 |
| 3035 | 3156 |
| 3036 | 3148 |
| 3037 | 3149 |
| 3038 | 3150 |
| 3039 | 3151 |
| 3040 | 3152 |

| IGH V/J SET 5 | |
|---|---|
| SEQ ID NO: V | SEQ ID NO: J |
| 3021 | 3152 |
| 3022 | 3153 |
| 3023 | 3154 |
| 3024 | 3155 |
| 3025 | 3156 |
| 3026 | 3148 |
| 3027 | 3149 |
| 3028 | 3150 |
| 3029 | 3151 |
| 3030 | 3152 |
| 3031 | 3153 |
| 3032 | 3154 |
| 3033 | 3155 |
| 3034 | 3156 |
| 3035 | 3148 |
| 3036 | 3149 |
| 3037 | 3150 |
| 3038 | 3151 |
| 3039 | 3152 |
| 3040 | 3153 |

| IGH V/J SET 6 | |
|---|---|
| SEQ ID NO: V | SEQ ID NO: J |
| 3021 | 3153 |
| 3022 | 3154 |
| 3023 | 3155 |
| 3024 | 3156 |
| 3025 | 3148 |
| 3026 | 3149 |
| 3027 | 3150 |
| 3028 | 3151 |
| 3029 | 3152 |
| 3030 | 3153 |
| 3031 | 3154 |
| 3032 | 3155 |
| 3033 | 3156 |
| 3034 | 3148 |
| 3035 | 3149 |
| 3036 | 3150 |
| 3037 | 3151 |
| 3038 | 3152 |
| 3039 | 3153 |
| 3040 | 3154 |

Fig. 7e

| IGH V/J SET 4 | | IGH V/J SET 5 | | IGH V/J SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3041 | 3153 | 3041 | 3154 | 3041 | 3155 |
| 3042 | 3154 | 3042 | 3155 | 3042 | 3156 |
| 3043 | 3155 | 3043 | 3156 | 3043 | 3148 |
| 3044 | 3156 | 3044 | 3148 | 3044 | 3149 |
| 3045 | 3148 | 3045 | 3149 | 3045 | 3150 |
| 3046 | 3149 | 3046 | 3150 | 3046 | 3151 |
| 3047 | 3150 | 3047 | 3151 | 3047 | 3152 |
| 3048 | 3151 | 3048 | 3152 | 3048 | 3153 |
| 3049 | 3152 | 3049 | 3153 | 3049 | 3154 |
| 3050 | 3153 | 3050 | 3154 | 3050 | 3155 |
| 3051 | 3154 | 3051 | 3155 | 3051 | 3156 |
| 3052 | 3155 | 3052 | 3156 | 3052 | 3148 |
| 3053 | 3156 | 3053 | 3148 | 3053 | 3149 |
| 3054 | 3148 | 3054 | 3149 | 3054 | 3150 |
| 3055 | 3149 | 3055 | 3150 | 3055 | 3151 |
| 3056 | 3150 | 3056 | 3151 | 3056 | 3152 |
| 3057 | 3151 | 3057 | 3152 | 3057 | 3153 |
| 3058 | 3152 | 3058 | 3153 | 3058 | 3154 |
| 3059 | 3153 | 3059 | 3154 | 3059 | 3155 |
| 3060 | 3154 | 3060 | 3155 | 3060 | 3156 |
| 3061 | 3155 | 3061 | 3156 | 3061 | 3148 |
| 3062 | 3156 | 3062 | 3148 | 3062 | 3149 |
| 3063 | 3148 | 3063 | 3149 | 3063 | 3150 |
| 3064 | 3149 | 3064 | 3150 | 3064 | 3151 |
| 3065 | 3150 | 3065 | 3151 | 3065 | 3152 |
| 3066 | 3151 | 3066 | 3152 | 3066 | 3153 |
| 3067 | 3152 | 3067 | 3153 | 3067 | 3154 |
| 3068 | 3153 | 3068 | 3154 | 3068 | 3155 |
| 3069 | 3154 | 3069 | 3155 | 3069 | 3156 |
| 3070 | 3155 | 3070 | 3156 | 3070 | 3148 |
| 3071 | 3156 | 3071 | 3148 | 3071 | 3149 |

Fig. 7f

| IGH V/J SET 4 | | IGH V/J SET 5 | | IGH V/J SET 6 | |
|---|---|---|---|---|---|
| SEQ ID NO:V | SEQ ID NO:J | SEQ ID NO:V | SEQ ID NO:J | SEQ ID NO:V | SEQ ID NO:J |
| 3072 | 3148 | 3072 | 3149 | 3072 | 3150 |
| 3073 | 3149 | 3073 | 3150 | 3073 | 3151 |
| 3074 | 3150 | 3074 | 3151 | 3074 | 3152 |
| 3075 | 3151 | 3075 | 3152 | 3075 | 3153 |
| 3076 | 3152 | 3076 | 3153 | 3076 | 3154 |
| 3077 | 3153 | 3077 | 3154 | 3077 | 3155 |
| 3078 | 3154 | 3078 | 3155 | 3078 | 3156 |
| 3079 | 3155 | 3079 | 3156 | 3079 | 3148 |
| 3080 | 3156 | 3080 | 3148 | 3080 | 3149 |
| 3081 | 3148 | 3081 | 3149 | 3081 | 3150 |
| 3082 | 3149 | 3082 | 3150 | 3082 | 3151 |
| 3083 | 3150 | 3083 | 3151 | 3083 | 3152 |
| 3084 | 3151 | 3084 | 3152 | 3084 | 3153 |
| 3085 | 3152 | 3085 | 3153 | 3085 | 3154 |
| 3086 | 3153 | 3086 | 3154 | 3086 | 3155 |
| 3087 | 3154 | 3087 | 3155 | 3087 | 3156 |
| 3088 | 3155 | 3088 | 3156 | 3088 | 3148 |
| 3089 | 3156 | 3089 | 3148 | 3089 | 3149 |
| 3090 | 3148 | 3090 | 3149 | 3090 | 3150 |
| 3091 | 3149 | 3091 | 3150 | 3091 | 3151 |
| 3092 | 3150 | 3092 | 3151 | 3092 | 3152 |
| 3093 | 3151 | 3093 | 3152 | 3093 | 3153 |
| 3094 | 3152 | 3094 | 3153 | 3094 | 3154 |
| 3095 | 3153 | 3095 | 3154 | 3095 | 3155 |
| 3096 | 3154 | 3096 | 3155 | 3096 | 3156 |
| 3097 | 3155 | 3097 | 3156 | 3097 | 3148 |
| 3098 | 3156 | 3098 | 3148 | 3098 | 3149 |
| 3099 | 3148 | 3099 | 3149 | 3099 | 3150 |
| 3100 | 3149 | 3100 | 3150 | 3100 | 3151 |
| 3101 | 3150 | 3101 | 3151 | 3101 | 3152 |
| 3102 | 3151 | 3102 | 3152 | 3102 | 3153 |

Fig. 7g

| IGH V/j SET 4 | | IGH V/j SET 5 | | IGH V/j SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3103 | 3152 | 3103 | 3153 | 3103 | 3154 |
| 3104 | 3153 | 3104 | 3154 | 3104 | 3155 |
| 3105 | 3154 | 3105 | 3155 | 3105 | 3156 |
| 3106 | 3155 | 3106 | 3156 | 3106 | 3148 |
| 3107 | 3156 | 3107 | 3148 | 3107 | 3149 |
| 3108 | 3148 | 3108 | 3149 | 3108 | 3150 |
| 3109 | 3149 | 3109 | 3150 | 3109 | 3151 |
| 3110 | 3150 | 3110 | 3151 | 3110 | 3152 |
| 3111 | 3151 | 3111 | 3152 | 3111 | 3153 |
| 3112 | 3152 | 3112 | 3153 | 3112 | 3154 |
| 3113 | 3153 | 3113 | 3154 | 3113 | 3155 |
| 3114 | 3154 | 3114 | 3155 | 3114 | 3156 |
| 3115 | 3155 | 3115 | 3156 | 3115 | 3148 |
| 3116 | 3156 | 3116 | 3148 | 3116 | 3149 |
| 3117 | 3148 | 3117 | 3149 | 3117 | 3150 |
| 3118 | 3149 | 3118 | 3150 | 3118 | 3151 |
| 3119 | 3150 | 3119 | 3151 | 3119 | 3152 |
| 3120 | 3151 | 3120 | 3152 | 3120 | 3153 |
| 3121 | 3152 | 3121 | 3153 | 3121 | 3154 |
| 3122 | 3153 | 3122 | 3154 | 3122 | 3155 |
| 3123 | 3154 | 3123 | 3155 | 3123 | 3156 |
| 3124 | 3155 | 3124 | 3156 | 3124 | 3148 |
| 3125 | 3156 | 3125 | 3148 | 3125 | 3149 |
| 3126 | 3148 | 3126 | 3149 | 3126 | 3150 |
| 3127 | 3149 | 3127 | 3150 | 3127 | 3151 |
| 3128 | 3150 | 3128 | 3151 | 3128 | 3152 |
| 3129 | 3151 | 3129 | 3152 | 3129 | 3153 |
| 3130 | 3152 | 3130 | 3153 | 3130 | 3154 |
| 3131 | 3153 | 3131 | 3154 | 3131 | 3155 |
| 3132 | 3154 | 3132 | 3155 | 3132 | 3156 |
| 3133 | 3155 | 3133 | 3156 | 3133 | 3148 |

| IGH V/J SET 4 | | IGH V/J SET 5 | | IGH V/J SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3134 | 3156 | 3134 | 3148 | 3134 | 3149 |
| 3135 | 3148 | 3135 | 3149 | 3135 | 3150 |
| 3136 | 3149 | 3136 | 3150 | 3136 | 3151 |
| 3137 | 3150 | 3137 | 3151 | 3137 | 3152 |
| 3138 | 3151 | 3138 | 3152 | 3138 | 3153 |
| 3139 | 3152 | 3139 | 3153 | 3139 | 3154 |
| 3140 | 3153 | 3140 | 3154 | 3140 | 3155 |
| 3141 | 3154 | 3141 | 3155 | 3141 | 3156 |
| 3142 | 3155 | 3142 | 3156 | 3142 | 3148 |
| 3143 | 3156 | 3143 | 3148 | 3143 | 3149 |
| 3144 | 3148 | 3144 | 3149 | 3144 | 3150 |
| 3145 | 3149 | 3145 | 3150 | 3145 | 3151 |
| 3146 | 3150 | 3146 | 3151 | 3146 | 3152 |
| 3147 | 3151 | 3147 | 3152 | 3147 | 3153 |

| IGH V/J SET 7 | | IGH V/J SET 8 | | IGH V/J SET 9 | |
|---|---|---|---|---|---|
| SEQ ID NO: V | SEQ ID NO: J | SEQ ID NO: V | SEQ ID NO: J | SEQ ID NO: V | SEQ ID NO: J |
| 3021 | 3154 | 3021 | 3155 | 3021 | 3156 |
| 3022 | 3155 | 3022 | 3156 | 3022 | 3148 |
| 3023 | 3156 | 3023 | 3148 | 3023 | 3149 |
| 3024 | 3148 | 3024 | 3149 | 3024 | 3150 |
| 3025 | 3149 | 3025 | 3150 | 3025 | 3151 |
| 3026 | 3150 | 3026 | 3151 | 3026 | 3152 |
| 3027 | 3151 | 3027 | 3152 | 3027 | 3153 |
| 3028 | 3152 | 3028 | 3153 | 3028 | 3154 |
| 3029 | 3153 | 3029 | 3154 | 3029 | 3155 |
| 3030 | 3154 | 3030 | 3155 | 3030 | 3156 |
| 3031 | 3155 | 3031 | 3156 | 3031 | 3148 |
| 3032 | 3156 | 3032 | 3148 | 3032 | 3149 |
| 3033 | 3148 | 3033 | 3149 | 3033 | 3150 |

| IGH V/J SET 7 | | IGH V/J SET 8 | | IGH V/J SET 9 | |
|---|---|---|---|---|---|
| SEQ ID NO: V | SEQ ID NO: J | SEQ ID NO: V | SEQ ID NO: J | SEQ ID NO: V | SEQ ID NO: J |
| 3034 | 3149 | 3034 | 3150 | 3034 | 3151 |
| 3035 | 3150 | 3035 | 3151 | 3035 | 3152 |
| 3036 | 3151 | 3036 | 3152 | 3036 | 3153 |
| 3037 | 3152 | 3037 | 3153 | 3037 | 3154 |
| 3038 | 3153 | 3038 | 3154 | 3038 | 3155 |
| 3039 | 3154 | 3039 | 3155 | 3039 | 3156 |
| 3040 | 3155 | 3040 | 3156 | 3040 | 3148 |
| 3041 | 3156 | 3041 | 3148 | 3041 | 3149 |
| 3042 | 3148 | 3042 | 3149 | 3042 | 3150 |
| 3043 | 3149 | 3043 | 3150 | 3043 | 3151 |
| 3044 | 3150 | 3044 | 3151 | 3044 | 3152 |
| 3045 | 3151 | 3045 | 3152 | 3045 | 3153 |
| 3046 | 3152 | 3046 | 3153 | 3046 | 3154 |
| 3047 | 3153 | 3047 | 3154 | 3047 | 3155 |
| 3048 | 3154 | 3048 | 3155 | 3048 | 3156 |
| 3049 | 3155 | 3049 | 3156 | 3049 | 3148 |
| 3050 | 3156 | 3050 | 3148 | 3050 | 3149 |
| 3051 | 3148 | 3051 | 3149 | 3051 | 3150 |
| 3052 | 3149 | 3052 | 3150 | 3052 | 3151 |
| 3053 | 3150 | 3053 | 3151 | 3053 | 3152 |
| 3054 | 3151 | 3054 | 3152 | 3054 | 3153 |
| 3055 | 3152 | 3055 | 3153 | 3055 | 3154 |
| 3056 | 3153 | 3056 | 3154 | 3056 | 3155 |
| 3057 | 3154 | 3057 | 3155 | 3057 | 3156 |
| 3058 | 3155 | 3058 | 3156 | 3058 | 3148 |
| 3059 | 3156 | 3059 | 3148 | 3059 | 3149 |
| 3060 | 3148 | 3060 | 3149 | 3060 | 3150 |
| 3061 | 3149 | 3061 | 3150 | 3061 | 3151 |
| 3062 | 3150 | 3062 | 3151 | 3062 | 3152 |
| 3063 | 3151 | 3063 | 3152 | 3063 | 3153 |
| 3064 | 3152 | 3064 | 3153 | 3064 | 3154 |

Fig. 7j

| IGH V/J SET 7 | | IGH V/J SET 8 | | IGH V/J SET 9 | |
|---|---|---|---|---|---|
| SEQ ID NO: V | SEQ ID NO:J | SEQ ID NO: V | SEQ ID NO:J | SEQ ID NO: V | SEQ ID NO:J |
| 3065 | 3153 | 3065 | 3154 | 3065 | 3155 |
| 3066 | 3154 | 3066 | 3155 | 3066 | 3156 |
| 3067 | 3155 | 3067 | 3156 | 3067 | 3148 |
| 3068 | 3156 | 3068 | 3148 | 3068 | 3149 |
| 3069 | 3148 | 3069 | 3149 | 3069 | 3150 |
| 3070 | 3149 | 3070 | 3150 | 3070 | 3151 |
| 3071 | 3150 | 3071 | 3151 | 3071 | 3152 |
| 3072 | 3151 | 3072 | 3152 | 3072 | 3153 |
| 3073 | 3152 | 3073 | 3153 | 3073 | 3154 |
| 3074 | 3153 | 3074 | 3154 | 3074 | 3155 |
| 3075 | 3154 | 3075 | 3155 | 3075 | 3156 |
| 3076 | 3155 | 3076 | 3156 | 3076 | 3148 |
| 3077 | 3156 | 3077 | 3148 | 3077 | 3149 |
| 3078 | 3148 | 3078 | 3149 | 3078 | 3150 |
| 3079 | 3149 | 3079 | 3150 | 3079 | 3151 |
| 3080 | 3150 | 3080 | 3151 | 3080 | 3152 |
| 3081 | 3151 | 3081 | 3152 | 3081 | 3153 |
| 3082 | 3152 | 3082 | 3153 | 3082 | 3154 |
| 3083 | 3153 | 3083 | 3154 | 3083 | 3155 |
| 3084 | 3154 | 3084 | 3155 | 3084 | 3156 |
| 3085 | 3155 | 3085 | 3156 | 3085 | 3148 |
| 3086 | 3156 | 3086 | 3148 | 3086 | 3149 |
| 3087 | 3148 | 3087 | 3149 | 3087 | 3150 |
| 3088 | 3149 | 3088 | 3150 | 3088 | 3151 |
| 3089 | 3150 | 3089 | 3151 | 3089 | 3152 |
| 3090 | 3151 | 3090 | 3152 | 3090 | 3153 |
| 3091 | 3152 | 3091 | 3153 | 3091 | 3154 |
| 3092 | 3153 | 3092 | 3154 | 3092 | 3155 |
| 3093 | 3154 | 3093 | 3155 | 3093 | 3156 |
| 3094 | 3155 | 3094 | 3156 | 3094 | 3148 |
| 3095 | 3156 | 3095 | 3148 | 3095 | 3149 |

Fig. 7k

| IGH V/J SET 7 | | IGH V/J SET 8 | | IGH V/J SET 9 | |
| --- | --- | --- | --- | --- | --- |
| SEQ ID NO:V | SEQ ID NO:J | SEQ ID NO:V | SEQ ID NO:J | SEQ ID NO:V | SEQ ID NO:J |
| 3096 | 3148 | 3096 | 3149 | 3096 | 3150 |
| 3097 | 3149 | 3097 | 3150 | 3097 | 3151 |
| 3098 | 3150 | 3098 | 3151 | 3098 | 3152 |
| 3099 | 3151 | 3099 | 3152 | 3099 | 3153 |
| 3100 | 3152 | 3100 | 3153 | 3100 | 3154 |
| 3101 | 3153 | 3101 | 3154 | 3101 | 3155 |
| 3102 | 3154 | 3102 | 3155 | 3102 | 3156 |
| 3103 | 3155 | 3103 | 3156 | 3103 | 3148 |
| 3104 | 3156 | 3104 | 3148 | 3104 | 3149 |
| 3105 | 3148 | 3105 | 3149 | 3105 | 3150 |
| 3106 | 3149 | 3106 | 3150 | 3106 | 3151 |
| 3107 | 3150 | 3107 | 3151 | 3107 | 3152 |
| 3108 | 3151 | 3108 | 3152 | 3108 | 3153 |
| 3109 | 3152 | 3109 | 3153 | 3109 | 3154 |
| 3110 | 3153 | 3110 | 3154 | 3110 | 3155 |
| 3111 | 3154 | 3111 | 3155 | 3111 | 3156 |
| 3112 | 3155 | 3112 | 3156 | 3112 | 3148 |
| 3113 | 3156 | 3113 | 3148 | 3113 | 3149 |
| 3114 | 3148 | 3114 | 3149 | 3114 | 3150 |
| 3115 | 3149 | 3115 | 3150 | 3115 | 3151 |
| 3116 | 3150 | 3116 | 3151 | 3116 | 3152 |
| 3117 | 3151 | 3117 | 3152 | 3117 | 3153 |
| 3118 | 3152 | 3118 | 3153 | 3118 | 3154 |
| 3119 | 3153 | 3119 | 3154 | 3119 | 3155 |
| 3120 | 3154 | 3120 | 3155 | 3120 | 3156 |
| 3121 | 3155 | 3121 | 3156 | 3121 | 3148 |
| 3122 | 3156 | 3122 | 3148 | 3122 | 3149 |
| 3123 | 3148 | 3123 | 3149 | 3123 | 3150 |
| 3124 | 3149 | 3124 | 3150 | 3124 | 3151 |
| 3125 | 3150 | 3125 | 3151 | 3125 | 3152 |
| 3126 | 3151 | 3126 | 3152 | 3126 | 3153 |

Fig. 7I

| IGH V/J SET 7 | | IGH V/J SET 8 | | IGH V/J SET 9 | |
|---|---|---|---|---|---|
| SEQ ID NO: V | SEQ ID NO:J | SEQ ID NO: V | SEQ ID NO:J | SEQ ID NO: V | SEQ ID NO:J |
| 3127 | 3152 | 3127 | 3153 | 3127 | 3154 |
| 3128 | 3153 | 3128 | 3154 | 3128 | 3155 |
| 3129 | 3154 | 3129 | 3155 | 3129 | 3156 |
| 3130 | 3155 | 3130 | 3156 | 3130 | 3148 |
| 3131 | 3156 | 3131 | 3148 | 3131 | 3149 |
| 3132 | 3148 | 3132 | 3149 | 3132 | 3150 |
| 3133 | 3149 | 3133 | 3150 | 3133 | 3151 |
| 3134 | 3150 | 3134 | 3151 | 3134 | 3152 |
| 3135 | 3151 | 3135 | 3152 | 3135 | 3153 |
| 3136 | 3152 | 3136 | 3153 | 3136 | 3154 |
| 3137 | 3153 | 3137 | 3154 | 3137 | 3155 |
| 3138 | 3154 | 3138 | 3155 | 3138 | 3156 |
| 3139 | 3155 | 3139 | 3156 | 3139 | 3148 |
| 3140 | 3156 | 3140 | 3148 | 3140 | 3149 |
| 3141 | 3148 | 3141 | 3149 | 3141 | 3150 |
| 3142 | 3149 | 3142 | 3150 | 3142 | 3151 |
| 3143 | 3150 | 3143 | 3151 | 3143 | 3152 |
| 3144 | 3151 | 3144 | 3152 | 3144 | 3153 |
| 3145 | 3152 | 3145 | 3153 | 3145 | 3154 |
| 3146 | 3153 | 3146 | 3154 | 3146 | 3155 |
| 3147 | 3154 | 3147 | 3155 | 3147 | 3156 |

Fig. 7m

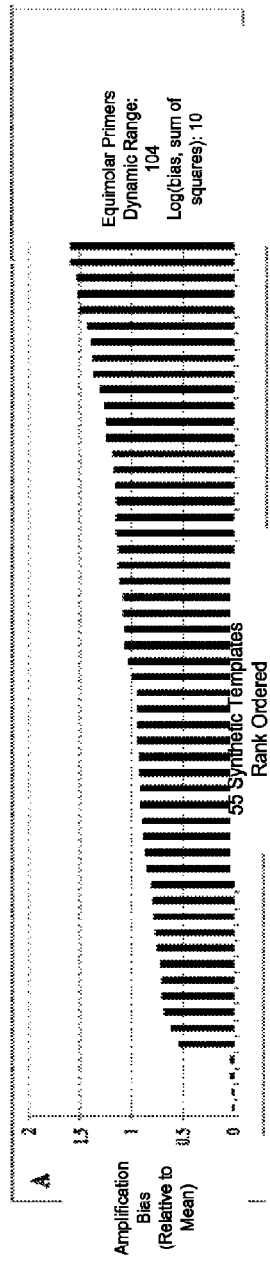
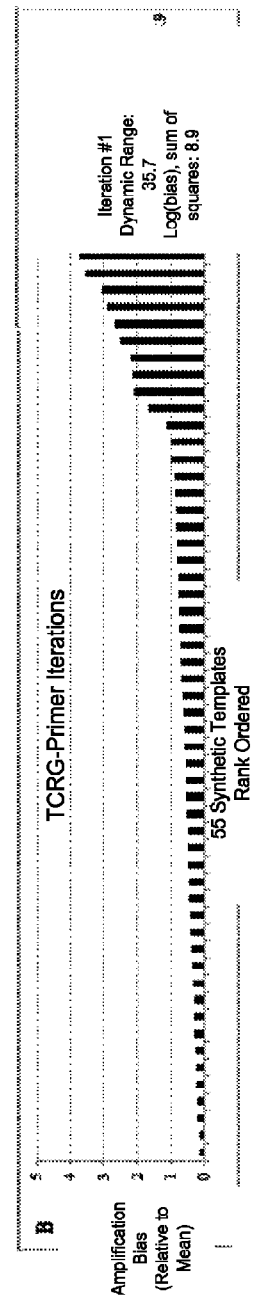
Fig. 14a
Fig. 14b

COMPOSITIONS AND METHOD FOR MEASURING AND CALIBRATING AMPLIFICATION BIAS IN MULTIPLEXED PCR REACTIONS

CROSS REFERENCE TO RELATED APPLICATIONS

This application is a continuation of U.S. application Ser. No. 14/381,967, filed on Aug. 28, 2014, and issued as U.S. Pat. No. 9,150,905 on Oct. 6, 2015, which is a U.S. national phase application of International Patent Application No. PCT/US2013/040221, filed May 8, 2013, which claims benefit of U.S. Provisional Application No. 61/726,489, filed Nov. 14, 2012 and U.S. Provisional Application No. 61/644,294, filed on May 8, 2012, the entire disclosure of which are hereby incorporated by reference in their entirties for all purposes.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: ADBS_001_03US_SeqList_ST25.txt, date recorded: Mar. 25, 2015, file size 4.65 MB).

BACKGROUND OF THE INVENTION

1. Field of the Invention

The present disclosure relates generally to quantitative high-throughput sequencing of adaptive immune receptor encoding DNA (e.g., DNA encoding T cell receptors (TCR) and immunoglobulins (IG) in multiplexed nucleic acid amplification reactions. In particular, the compositions and methods described herein overcome undesirable distortions in the quantification of adaptive immune receptor encoding sequences that can result from biased over-utilization and/or under-utilization of specific oligonucleotide primers in multiplexed DNA amplification.

2. Description of the Related Art

The adaptive immune system employs several strategies to generate a repertoire of T- and B-cell antigen receptors, i.e., adaptive immune receptors, with sufficient diversity to recognize the universe of potential pathogens. The ability of T cells to recognize the universe of antigens associated with various cancers or infectious organisms is conferred by its T cell antigen receptor (TCR), which is a heterodimer of an α (alpha) chain from the TCRA locus and β (beta) chain from the TCRB locus, or a heterodimer of a γ (gamma) chain from the TCRG locus and a δ (delta) chain from the TCRD locus. The proteins which make up these chains are encoded by DNA, which in lymphoid cells employs a unique rearrangement mechanism for generating the tremendous diversity of the TCR. This multi-subunit immune recognition receptor associates with the CD3 complex and binds to peptides presented by either the major histocompatibility complex (MHC) class I or MHC class II proteins on the surface of antigen-presenting cells (APCs). Binding of TCR to the antigenic peptide on the APC is the central event in T cell activation, which occurs at an immunological synapse at the point of contact between the T cell and the APC.

Each TCR peptide contains variable complementarity determining regions (CDRs), as well as framework regions (FRs) and a constant region. The sequence diversity of αβT cells is largely determined by the amino acid sequence of the third complementarity-determining region (CDR3) loops of the α and β chain variable domains, which diversity is a result of recombination between variable ($V_\beta$), diversity ($D_\beta$), and joining ($J_\beta$) gene segments in the β chain locus, and between analogous $J_\alpha$ and $J_\alpha$ gene segments in the α chain locus, respectively. The existence of multiple such gene segments in the TCR α and β chain loci allows for a large number of distinct CDR3 sequences to be encoded. CDR3 sequence diversity is further increased by independent addition and deletion of nucleotides at the $V_\beta$-$D_\beta$, $D_\beta$-$J_\beta$, and $V_\alpha$-$J_\alpha$ junctions during the process of TCR gene rearrangement. In this respect, immunocompetence is derived from the diversity of TCRs.

The γδ TCR heterodimer is distinctive from the αβTCR in that it encodes a receptor that interacts closely with the innate immune system, and recognizes antigen in a non-HLA-dependent manner. TCRγδ is expressed early in development, and has specialized anatomical distribution, unique pathogen and small-molecule specificities, and a broad spectrum of innate and adaptive cellular interactions. A biased pattern of TCRγ V and J segment expression is established early in ontogeny. Consequently, the diverse TCRγ repertoire in adult tissues is the result of extensive peripheral expansion following stimulation by environmental exposure to pathogens and toxic molecules.

Immunoglobulins (Igs or IG), also referred to herein as B cell receptors (BCR), are proteins expressed by B cells consisting of four polypeptide chains, two heavy chains (H chains) from the IGH locus and two light chains (L chains) from either the IGK or the IGL locus, forming an $H_2L_2$ structure. H and L chains each contain three complementarity determining regions (CDR) involved in antigen recognition, as well as framework regions and a constant domain, analogous to TCR. The H chains of Igs are initially expressed as membrane-bound isoforms using either the IGM or IGD constant region exons, but after antigen recognition the constant region can class-switch to several additional isotypes, including IGG, IGE and IGA. As with TCR, the diversity of naïve Igs within an individual is mainly determined by the hypervariable complementarity determining regions (CDR). Similar to TCRB, the CDR3 domain of H chains is created by the combinatorial joining of the $V_H$, $D_H$, and $J_H$ gene segments. Hypervariable domain sequence diversity is further increased by independent addition and deletion of nucleotides at the $V_H$-$D_H$, $D_H$-$J_H$, and $V_H$-$J_H$ junctions during the process of Ig gene rearrangement. Distinct from TCR, Ig sequence diversity is further augmented by somatic hypermutation (SHM) throughout the rearranged IG gene after a naïve B cell initially recognizes an antigen. The process of SHM is not restricted to CDR3, and therefore can introduce changes to the germline sequence in framework regions, CDR1 and CDR2, as well as in the somatically rearranged CDR3.

As the adaptive immune system functions in part by clonal expansion of cells expressing unique TCRs or BCRs, accurately measuring the changes in total abundance of each T cell or B cell clone is important to understanding the dynamics of an adaptive immune response. For instance, a healthy human has a few million unique rearranged TCRβ chains, each carried in hundreds to thousands of clonal T-cells, out of the roughly trillion T cells in a healthy individual. Utilizing advances in high-throughput sequencing, a new field of molecular immunology has recently emerged to profile the vast TCR and BCR repertoires. Compositions and methods for the sequencing of rearranged adaptive immune receptor gene sequences and for adaptive immune receptor clonotype determination are described in U.S. application Ser. No.

13/217,126; U.S. application Ser. No. 12/794,507; PCT/US2011/026373; and PCT/US2011/049012, all herein incorporated by reference.

To date, several different strategies have been employed to sequence nucleic acids encoding adaptive immune receptors quantitatively at high throughput, and these strategies may be distinguished, for example, by the approach that is used to amplify the CDR3-encoding regions, and by the choice of sequencing genomic DNA (gDNA) or messenger RNA (mRNA).

Sequencing mRNA is a potentially easier method than sequencing gDNA, because mRNA splicing events remove the intron between J and C segments. This allows for the amplification of adaptive immune receptors (e.g., TCRs or Igs) having different V regions and J regions using a common 3' PCR primer in the C region. For each TCRβ, for example, the thirteen J segments are all less than 60 base pairs (bp) long. Therefore, splicing events bring identical polynucleotide sequences encoding TCRβ constant regions (regardless of which V and J sequences are used) within less than 100 bp of the rearranged VDJ junction. The spliced mRNA can then be reverse transcribed into complementary DNA (cDNA) using poly-dT primers complementary to the poly-A tail of the mRNA, random small primers (usually hexamers or nonamers) or C-segment-specific oligonucleotides. This should produce an unbiased library of TCR cDNA (because all cDNAs are primed with the same oligonucleotide, whether poly-dT, random hexamer, or C segment-specific oligo) that may then be sequenced to obtain information on the V and J segment used in each rearrangement, as well as the specific sequence of the CDR3. Such sequencing could use single, long reads spanning CDR3 ("long read") technology, or could instead involve shotgun assembly of the longer sequences using fragmented libraries and higher throughput shorter sequence reads.

Efforts to quantify the number of cells in a sample that express a particular rearranged TCR (or Ig) based on mRNA sequencing are difficult to interpret, however, because each cell potentially expresses different quantities of TCR mRNA. For example, T cells activated in vitro have 10-100 times as much mRNA per cell than quiescent T cells. To date, there is very limited information on the relative amount of TCR mRNA in T cells of different functional states, and therefore quantitation of mRNA in bulk does not necessarily accurately measure the number of cells carrying each clonal TCR rearrangement.

Most T cells, on the other hand, have one productively rearranged TCRα and one productively rearranged TCRβ gene (or two rearranged TCRγ and TCRδ), and most B cells have one productively rearranged Ig heavy-chain gene and one productively rearranged Ig light-chain gene (either ICK or IGL) so quantification in a sample of genomic DNA encoding TCRs or BCRs should directly correlate with, respectively, the number of T or B cells in the sample. Genomic sequencing of polynucleotides encoding any one or more of the adaptive immune receptor chains desirably entails amplifying with equal efficiency all of the many possible rearranged CDR3 sequences that are present in a sample containing DNA from lymphoid cells of a subject, followed by quantitative sequencing, such that a quantitative measure of the relative abundance of each rearranged CDR3 clonotype can be obtained.

Difficulties are encountered with such approaches, however, in that equal amplification and sequencing efficiencies may not be achieved readily for each rearranged clone using multiplex PCR. For example, at TCRB each clone employs one of 54 possible germline V region-encoding genes and one of 13 possible J region-encoding genes. The DNA sequence of the V and J segments is necessarily diverse, in order to generate a diverse adaptive immune repertoire. This sequence diversity makes it impossible to design a single, universal primer sequence that will anneal to all V segments (or J segments) with equal affinity, and yields complex DNA samples in which accurate determination of the multiple distinct sequences contained therein is hindered by technical limitations on the ability to quantify a plurality of molecular species simultaneously using multiplexed amplification and high throughput sequencing.

One or more factors can give rise to artifacts that skew the correlation between sequencing data outputs and the number of copies of an input clonotype, compromising the ability to obtain reliable quantitative data from sequencing strategies that are based on multiplexed amplification of a highly diverse collection of TCRβ gene templates. These artifacts often result from unequal use of diverse primers during the multiplexed amplification step. Such biased utilization of one or more oligonucleotide primers in a multiplexed reaction that uses diverse amplification templates may arise as a function of differential annealing kinetics due to one or more of differences in the nucleotide base composition of templates and/or oligonucleotide primers, differences in template and/or primer length, the particular polymerase that is used, the amplification reaction temperatures (e.g., annealing, elongation and/or denaturation temperatures), and/or other factors (e.g., Kanagawa, 2003 *J. Biosci. Bioeng.* 96:317; Day et al., 1996 *Hum. Mol. Genet.* 5:2039; Ogino et al., 2002 *J. Mol. Diagnost.* 4:185; Barnard et al., 1998 *Biotechniques* 25:684; Aird et al., 2011 *Genome Biol.* 12:R18).

Clearly there remains a need for improved compositions and methods that will permit accurate quantification of adaptive immune receptor-encoding DNA sequence diversity in complex samples, in a manner that avoids skewed results such as misleading over- or underrepresentation of individual sequences due to biases in the amplification of specific templates in an oligonucleotide primer set used for multiplexed amplification of a complex template DNA population. The presently described embodiments address this need and provide other related advantages.

SUMMARY OF THE INVENTION

A composition for standardizing the amplification efficiency of an oligonucleotide primer set that is capable of amplifying rearranged nucleic acid molecules encoding one or more adaptive immune receptors in a biological sample that comprises rearranged nucleic acid molecules from lymphoid cells of a mammalian subject, each adaptive immune receptor comprising a variable region and a joining region, the composition comprising a plurality of template oligonucleotides having a plurality of oligonucleotide sequences of general formula: 5'-U1-B1-V-B2-R-B3-J-B4-U2-3' [1] wherein: (a) V is a polynucleotide comprising at least 20 and not more than 1000 contiguous nucleotides of an adaptive immune receptor variable (V) region encoding gene sequence, or the complement thereof, and each V polynucleotide comprising a unique oligonucleotide sequence; (b) J is a polynucleotide comprising at least 15 and not more than 600 contiguous nucleotides of an adaptive immune receptor joining (J) region encoding gene sequence, or the complement thereof, and each J polynucleotide comprising a unique oligonucleotide sequence; (c) U1 is either nothing or comprises an oligonucleotide sequence that is selected from (i) a first universal adaptor oligonucleotide sequence and (ii) a first sequencing platform-specific oligonucleotide sequence that is linked to and positioned 5' to a first universal adaptor oligonucleotide sequence; (d) U2 is either nothing or comprises an oligonucleotide sequence that is selected from (i) a second universal adaptor oligonucleotide sequence, and (ii) a second sequencing platform-specific oligonucleotide sequence that is linked to and positioned 5' to a second universal adaptor oligonucleotide sequence; (e) B1, B2, B3, and B4 are each independently either nothing or each comprises an oligonucleotide B that comprises a barcode sequence of 3-25 contiguous nucleotides, wherein each B1, B2, B3 and B4 comprises an oligonucleotide sequence that uniquely identifies, as a paired combination, (i) the unique V oligonucleotide sequence of (a) and (ii) the unique J oligonucleotide sequence of (b);(f) R is either nothing or comprises a restriction enzyme recognition site that comprises an oligonucleotide sequence that is absent from (a)-(e), and wherein: (g) the plurality of template oligonucleotides comprises at least a or at least b unique oligonucleotide sequences, whichever is larger, wherein a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide.

In one embodiment, a is 1 to a number of maximum V gene segments in the mammalian genome of the subject. In another embodiment, b is 1 to a number of maximum J gene segments in the mammalian genome of the subject. In other embodiments, a is 1 or b is 1.

In some embodiments, the plurality of template oligonucleotides comprises at least (a×b) unique oligonucleotide sequences, where a is the number of unique adaptive immune receptor V region-encoding gene segments in the mammalian subject and b is the number of unique adaptive immune receptor J region-encoding gene segments in the mammalian subject, and the composition comprises at least one template oligonucleotide for every possible combination of a V region-encoding gene segment and a J region-encoding gene segment. In one embodiment, J comprises a constant region of the adaptive immune receptor J region encoding gene sequence.

In another embodiment, the adaptive immune receptor is selected from the group consisting of TCRB, TCRG, TCRA, TCRD, IGH, IGK, and IGL. In some embodiments, the V polynucleotide of (a) encodes a TCRB, TCRG, TCRA, TCRD, IGH, IGK, or IGL receptor V-region polypeptide. In other embodiments, the J polynucleotide of (b) encodes a TCRB, TCRG, TCRA, TCRD, IGH, IGK, or IGL receptor J-region polypeptide.

In some embodiments, a stop codon is between V and B2.

In one embodiment, each template oligonucleotide in the plurality of template oligonucleotides is present in a substantially equimolar amount. In another embodiment, the plurality of template oligonucleotides have a plurality of sequences of general formula (I) that is selected from: (1) the plurality of oligonucleotide sequences of general formula (I) in which the V and J polynucleotides have the TCRB V and J sequences set forth in at least one set of 68 TCRB V and J SEQ ID NOs. in FIGS. 5a-5l as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13; (2) the plurality of oligonucleotide sequences of general formula (I) in which the V and J polynucleotides have the TCRG V and J sequences set forth in at least one set of 14 TCRG V and J SEQ ID NOs. in FIGS. 6a and 6b as TCRG V/J set 1, TCRG V/J set 2, TCRG V/J set 3, TCRG V/J set 4 and TCRG V/J set 5; (3) the plurality of oligonucleotide sequences of general formula (I) in which the V and J polynucleotides have the IGH V and J sequences set forth in at least one set of 127 IGH V and J SEQ ID NOs. in FIGS. 7a-7m as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9; (4) the plurality of oligonucleotide sequences of general formula (I) as set forth in SEQ ID NOS:3157-4014; (5) the plurality of oligonucleotide sequences of general formula (I) as set forth in SEQ ID NOS:4015-4084; (6) the plurality of oligonucleotide sequences of general formula (I) as set forth in SEQ ID NOS:4085-5200; (7) the plurality of oligonucleotide sequences of general formula (I) as set forth in SEQ ID NOS:5579-5821; (8) the plurality of oligonucleotide sequences of general formula (I) as set forth in SEQ ID NOS: 5822-6066; and (9) the plurality of oligonucleotide sequences of general formula (I) as set forth in SEQ ID NOS: 6067-6191.

In some embodiments, V is a polynucleotide comprising at least 30, 60, 90, 120, 150, 180, or 210 contiguous nucleotides of the adaptive immune receptor V region encoding gene sequence, or the complement thereof. In another embodiment, V is a polynucleotide comprising not more than 900, 800, 700, 600 or 500 contiguous nucleotides of an adaptive immune receptor V region encoding gene sequence, or the complement thereof.

In other embodiments, J is a polynucleotide comprising at least 16-30, 31-60, 61-90, 91-120, or 120-150 contiguous nucleotides of an adaptive immune receptor J region encoding gene sequence, or the complement thereof. In another embodiment, J is a polynucleotide comprising not more than 500, 400, 300 or 200 contiguous nucleotides of an adaptive immune receptor J region encoding gene sequence, or the complement thereof.

In some embodiments, each template oligonucleotide is less than 1000, 900, 800, 700, 600, 500, 400, 300 or 200 nucleotides in length.

In other embodiments, the composition includes a set of oligonucleotide primers that is capable of amplifying rearranged nucleic acid molecules encoding one or more adaptive immune receptors comprising a plurality a' of unique V-segment oligonucleotide primers and a plurality b' of unique J-segment oligonucleotide primers. In some embodiments, a' is 1 to a number of maximum V gene segments in the mammalian genome, and b' is 1 to a number of maximum number of J gene segments in the mammalian genome. In one embodiment, a' is a. In another embodiment, b' is b.

In yet another embodiment, each V-segment oligonucleotide primer and each J-segment oligonucleotide primer in the oligonucleotide primer set is capable of specifically hybridizing to at least one template oligonucleotide in the plurality of template oligonucleotides. In other embodiments, each V-segment oligonucleotide primer comprises a nucleotide sequence of at least 15 contiguous nucleotides that is complementary to at least one adaptive immune receptor V region-encoding gene segment. In another embodiment, each J-segment oligonucleotide primer comprises a nucleotide sequence of at least 15 contiguous nucleotides that is complementary to at least one adaptive immune receptor J region-encoding gene segment.

In other embodiments, the composition comprises at least one template oligonucleotide having an oligonucleotide sequence of general formula (I) to which each V-segment oligonucleotide primer can specifically hybridize, and at least one template oligonucleotide having an oligonucleotide sequence of general formula (I) to which each J-segment oligonucleotide primer can specifically hybridize.

The invention comprises a method for determining non-uniform nucleic acid amplification potential among members of a set of oligonucleotide primers that is capable of amplifying rearranged nucleic acid molecules encoding one or more adaptive immune receptors in a biological sample that comprises rearranged nucleic acid molecules from lymphoid cells of a mammalian subject. The method includes steps for: (a) amplifying the composition as described herein in a multiplex PCR reaction to obtain a plurality of amplified template oligonucleotides; (b) sequencing said plurality of amplified template oligonucleotides to determine, for each unique template oligonucleotide comprising said plurality, (i) a template oligonucleotide sequence and (ii) a frequency of occurrence of said template oligonucleotide sequence; and (c) comparing a frequency of occurrence of each of said template oligonucleotide sequences to an expected distribution, wherein said expected distribution is based on predetermined molar ratios of said plurality of template oligonucleotides comprising said composition, and wherein a deviation between said frequency of occurrence of said template oligonucleotide sequences and said expected distribution indicates a non-uniform nucleic acid amplification potential among members of the set of oligonucleotide amplification primers.

In one embodiment, the predetermined molar ratios are equimolar. In another embodiment, the expected distribution comprises a uniform amplification level for said set of template oligonucleotides amplified by said set of oligonucleotide primers. In yet another embodiment, each amplified template nucleic acid molecule is less than 1000, 900, 800, 700, 600, 500, 400, 300, 200, 100, 90, 80 or 70 nucleotides in length.

The method includes steps comprising for each member of the set of oligonucleotide primers that exhibits non-uniform amplification potential relative to the expected distribution, adjusting the relative representation of the oligonucleotide primer member in the set of oligonucleotide amplification primers. In one embodiment, adjusting comprises increasing the relative representation of the member in the set of oligonucleotide primers, thereby correcting non-uniform nucleic acid amplification potential among members of the set of oligonucleotide primers. In another embodiment, adjusting comprises decreasing the relative representation of the member in the set of oligonucleotide primers, thereby correcting non-uniform nucleic acid amplification potential among members of the set of oligonucleotide primers.

In other embodiments, the set of oligonucleotide primers does not include oligonucleotide primers that specifically hybridize to a V-region pseudogene or orphon or to a J-region pseudogene or orphon.

The method also includes steps comprising: for each member of the set of oligonucleotide amplification primers that exhibits non-uniform amplification potential relative to the expected distribution, calculating a proportionately increased or decreased frequency of occurrence of the amplified template nucleic acid molecules, the amplification of which is promoted by said member, thereby correcting for non-uniform nucleic acid amplification potential among members of the set of oligonucleotide primers.

The invention includes a method for quantifying a plurality of rearranged nucleic acid molecules encoding one or a plurality of adaptive immune receptors in a biological sample that comprises rearranged nucleic acid molecules from lymphoid cells of a mammalian subject, each adaptive immune receptor comprising a variable (V) region and a joining (J) region, the method comprising: (A) amplifying rearranged nucleic acid molecules in a multiplex polymerase chain reaction (PCR) that comprises: (1) rearranged nucleic acid molecules from the biological sample that comprises lymphoid cells of the mammalian subject; (2) the composition as described herein wherein a known number of each of the plurality of template oligonucleotides having a unique oligonucleotide sequence is present; (3) an oligonucleotide amplification primer set that is capable of amplifying rearranged nucleic acid molecules encoding one or a plurality of adaptive immune receptors from the biological sample.

In some embodiments, the primer set comprises: (a) in substantially equimolar amounts, a plurality of V-segment oligonucleotide primers that are each independently capable of specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one functional adaptive immune receptor V region-encoding gene segment and wherein the plurality of V-segment primers specifically hybridize to substantially all functional adaptive immune receptor V region-encoding gene segments that are present in the composition, and (b) in substantially equimolar amounts, a plurality of J-segment oligonucleotide primers that are each independently capable of specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one functional adaptive immune receptor J region-encoding gene segment and wherein the plurality of J-segment primers specifically hybridize to substantially all functional adaptive immune receptor J region-encoding gene segments that are present in the composition.

In another embodiment, the V-segment and J-segment oligonucleotide primers are capable of promoting amplification in said multiplex polymerase chain reaction (PCR) of (i) substantially all template oligonucleotides in the composition to produce a multiplicity of amplified template oligonucleotides, said multiplicity of amplified template nucleic acid molecules being sufficient to quantify diversity of the template oligonucleotides in the composition, and (ii) substantially all rearranged nucleic acid molecules encoding adaptive immune receptors in the biological sample to produce a multiplicity of amplified rearranged DNA molecules, said multiplicity of amplified rearranged nucleic acid molecules being sufficient to quantify diversity of the rearranged nucleic acid molecules in the DNA from the biological sample.

In one embodiment, each amplified nucleic acid molecule in the plurality of amplified template oligonucleotides and in the plurality of amplified rearranged nucleic acid molecules is less than 1000 nucleotides in length; (B) quantitatively sequencing said amplified template oligonucleotides and said amplified rearranged nucleic acid molecules to quantify (i) a template product number of amplified template oligonucleotides which contain at least one oligonucleotide barcode sequence, and (ii) a rearranged product number of amplified rearranged nucleic acid molecules which lack an oligonucleotide barcode sequence; (C) calculating an amplification factor by dividing the template product number of (B)(i) by the known number of each of the plurality of template oligonucleotides having a unique oligonucleotide sequence of (A)(2); and (D) dividing the rearranged product number of (B)(ii) by the amplification factor calculated in (C) to quantify the number of unique adaptive immune receptor encoding rearranged nucleic acid molecules in the sample.

In other embodiments, the quantified number of unique adaptive immune receptor encoding rearranged nucleic acid molecules in the sample is the number of unique B cell or unique T cell genome templates in the sample.

The invention includes a method for calculating an average amplification factor in a multiplex PCR assay, comprising: obtaining a biological sample that comprises rearranged nucleic acid molecules from lymphoid cells of a mammalian subject; contacting said sample with a known quantity of template oligonucleotides comprising a composition as described herein; amplifying the template oligonucleotides and the rearranged nucleic acid molecules from lymphoid cells of the mammalian subject in a multiplex PCR reaction to obtain a plurality of amplified template oligonucleotides and a plurality of amplified rearranged nucleic acid molecules; sequencing said plurality of amplified template oligonucleotides to determine, for each unique template oligonucleotide comprising said plurality, (i) a template oligonucleotide sequence and (ii) a frequency of occurrence of said template oligonucleotide sequence; and determining an average amplification factor for said multiplex PCR reaction based on an average number of copies of said plurality of amplified template oligonucleotides and said known quantity of said template oligonucleotides.

The method also includes sequencing said plurality of amplified rearranged nucleic acid molecules from lymphoid cells of the mammalian subject to determine for each unique rearranged nucleic acid molecule comprising said plurality, i) a rearranged nucleic acid molecule sequence and (ii) a number of occurrences of said rearranged nucleic acid molecule sequence; and determining the number of lymphoid cells in said sample, based on the average amplification factor for said multiplex PCR reaction and said number of occurrences of said rearranged nucleic acid molecules.

In other embodiments, the method comprises determining the number of lymphoid cells in said sample comprises generating a sum of the number of occurrences of each of said amplified rearranged nucleic acid sequences and dividing said sum by said average amplification factor. In some embodiments, the known quantity is one copy each of said template oligonucleotides. In one embodiment, $100 \leq a \leq 500$. In another embodiment, $100 \leq b \leq 500$.

A method is provided for correcting for amplification bias in an multiplex PCR amplification reaction to quantify rearranged nucleic acid molecules encoding one or a plurality of adaptive immune receptors in a biological sample that comprises rearranged nucleic acid molecules from lymphoid cells of a mammalian subject, comprising: (a) contacting said sample with a composition described herein to generate a template-spiked sample, wherein said templates and said rearranged nucleic acid molecules comprise corresponding V and J region sequences; (b) amplifying said template-spiked sample in a multiplex PCR reaction to obtain a plurality of amplified template oligonucleotides and a plurality of amplified rearranged nucleic acid molecules encoding a plurality of adaptive immune receptors; (c) sequencing said plurality of amplified template oligonucleotides to determine, for each unique template oligonucleotide comprising said plurality, (i) a template oligonucleotide sequence and (ii) a frequency of occurrence of said template oligonucleotide sequence; (d) sequencing said plurality of amplified rearranged nucleic acid molecules encoding one or a plurality of adaptive immune receptors, for each unique rearranged nucleic acid molecules encoding said plurality of adaptive immune receptors comprising said plurality, (i) a rearranged nucleic acid molecule sequence and (ii) a frequency of occurrence of said rearranged nucleic acid molecule sequence; (e) comparing frequency of occurrence of said template oligonucleotide sequences to an expected distribution, wherein said expected distribution is based on predetermined molar ratios of said plurality of template oligonucleotides comprising said composition, and wherein a deviation between said frequency of occurrence of said template oligonucleotide sequences and said expected distribution indicates non-uniform nucleic acid amplification potential among members of the set of oligonucleotide amplification primers; (f) generating a set of correction values for a set of template molecules and rearranged nucleic acid molecule sequences amplified by said members of the set of oligonucleotide amplification primers having said indicated non-uniform nucleic acid amplification potential, wherein said set of correction values corrects for amplification bias in said multiplex PCR reaction; and (g) optionally applying said set of correction values to said frequency of occurrence of said rearranged nucleic acid molecule sequences to correct for amplification bias in said multiplex PCR reaction.

The invention comprises a kit, comprising: reagents comprising: a composition comprising a plurality of template oligonucleotides and a set of oligonucleotide primers as described herein; instructions for determining a non-uniform nucleic acid amplification potential among members of the set of oligonucleotide primers that are capable of amplifying rearranged nucleic acid molecules encoding one or more adaptive immune receptors in a biological sample that comprises rearranged nucleic acid molecules from lymphoid cells of a mammalian subject.

In another embodiment, the kit comprises instructions for correcting for one or more members of the set of oligonucleotide primers having a non-uniform nucleic acid amplification potential.

In other embodiments, the kit comprises instructions for quantifying the number of unique adaptive immune receptor encoding rearranged nucleic acid molecules in the sample These and other aspects of the herein described invention embodiments will be evident upon reference to the following detailed description and attached drawings. All of the U.S. patents, U.S. patent application publications, U.S. patent applications, foreign patents, foreign patent applications and non-patent publications referred to in this specification and/or listed in the Application Data Sheet are incorporated herein by reference in their entirety, as if each was incorporated individually. Aspects and embodiments of the invention can be modified, if necessary, to employ concepts of the various patents, applications and publications to provide yet further embodiments.

BRIEF DESCRIPTION OF THE SEVERAL VIEWS OF THE DRAWINGS

These and other features, aspects, and advantages of the present invention will become better understood with regard to the following description, and accompanying drawings, where:

Figure (FIG. 1) shows a schematic diagram of an exemplary template oligonucleotide for use in standardizing the amplification efficiency of an oligonucleotide primer set that is capable of amplifying rearranged DNA encoding an adaptive immune receptor (TCR or BCR). U1, U2, universal adaptor oligonucleotides; B1-4, barcode oligonucleotides; V, variable region oligonucleotide; J, joining region oligonucleotide; R, restriction enzyme recognition site; S, optional stop codon.

FIGS. 5a-5l show TCRB V/J sets (68 V+13 J) for use in template compositions that comprise a plurality of oligonucleotide sequences of general formula 5'-U1-B1-V-B2-R-B3-J-B4-U2-3' [I], for use in standardizing the amplification efficiency of an oligonucleotide primer set that is capable of amplifying rearranged DNA encoding one or a plurality of human T cell receptor β (TCRB) chain polypeptides.

FIGS. 6a and 6b show TCRG V/J sets (14 V+5 J) for use in template compositions that comprise a plurality of oligonucleotide sequences of general formula 5'-U1-B1-V-B2-R-B3-J-B4-U2-3' [I], for use in standardizing the amplification efficiency of an oligonucleotide primer set that is capable of amplifying rearranged DNA encoding one or a plurality of human T cell receptor γ (TCRG) chain polypeptides.

FIGS. 7a-7m show IGH V/J sets (127 V+9 J) for use in template compositions that comprise a plurality of oligonucleotide sequences of general formula 5'-U1-B1-V-B2-R-B3-J-B4-U2-3' [I], for use in standardizing the amplification efficiency of an oligonucleotide primer set that is capable of amplifying rearranged DNA encoding one or a plurality of human immunoglobulin heavy (IGH) chain polypeptides.

FIGS. 14a-d show TCRG-primer iterations for 55 synthetic TCRG VJ templates. Relative amplification bias was determined for the TCRG VJ primers prior to chemical bias control correction (FIG. 14a), 1st iteration of chemical correction (FIG. 14b), 2nd iteration of chemical correction (FIG. 14c), and final iteration of chemical correction (FIG. 14d).

DETAILED DESCRIPTION OF THE INVENTION

Figure 1:
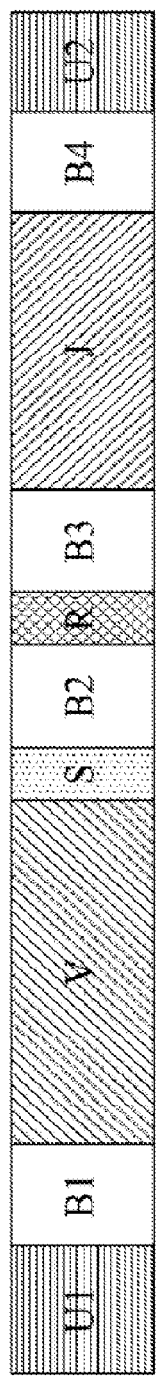

The present invention provides, in certain embodiments and as described herein, compositions and methods that are useful for reliably quantifying large and structurally diverse populations of rearranged genes encoding adaptive immune receptors, such as immunoglobulins (Ig) and/or T cell receptors (TCR). These rearranged genes may be present in a biological sample containing DNA from lymphoid cells of a subject or biological source, including a human subject.

A "rearranged nucleic acid molecule," as used herein, can include any genomic DNA, cDNA, or mRNA obtained directly or indirectly from a lymphoid cell line that includes sequences that encode a rearranged adaptive immune receptor.

Disclosed herein are unexpectedly advantageous approaches for the standardization and calibration of complex oligonucleotide primer sets that are used in multiplexed nucleic acid amplification reactions to generate a population of amplified rearranged DNA molecules from a biological sample containing rearranged genes encoding adaptive immune receptors, prior to quantitative high throughput sequencing of such amplified products. Multiplexed amplification and high throughput sequencing of rearranged TCR and BCR (IG) encoding DNA sequences are described, for example, in Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09.001; Sherwood et al. 2011 *Sci. Translat. Med.* 3:90ra61; U.S. application Ser. No. 13/217,126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118; accordingly these disclosures are incorporated by reference and may be adapted for use according to the embodiments described herein.

Briefly and according to non-limiting theory, the present compositions and methods overcome inaccuracies that may arise in current methods which quantify TCR and BCR gene diversity by sequencing the products of multiplexed nucleic acid amplification. To accommodate the vast diversity of TCR and BCR gene template sequences that may be present in a biological sample, oligonucleotide primer sets used in multiplexed amplification reactions typically comprise a wide variety of sequence lengths and nucleotide compositions (e.g., GC content). Consequently, under a given set of amplification reaction conditions, the efficiencies at which different primers anneal to and support amplification of their cognate template sequences may differ markedly, resulting in non-uniform utilization of different primers, which leads to artifactual biases in the relative quantitative representation of distinct amplification products.

For instance, relative overutilization of some highly efficient primers results in overrepresentation of certain amplification products, and relative underutilization of some other low-efficiency primers results in underrepresentation of certain other amplification products. Quantitative determination of the relative amount of each template species that is present in the lymphoid cell DNA-containing sample, which is achieved by sequencing the amplification products, may then yield misleading information with respect to the actual relative representation of distinct template species in the sample prior to amplification. In pilot studies, for example, it was observed that multiplexed PCR, using a set of oligonucleotide primers designed to be capable of amplifying a sequence of every possible human TCRB variable (V) region gene from human lymphoid cell DNA templates, did not uniformly amplify TCRB V gene segments. Instead, some V gene segments were relatively overamplified (representing ~10% of total sequences) and other V gene segments were relatively underamplified (representing about $4 \times 10^{-3}\%$ of total sequences); see also, e.g., FIG. 2.

To overcome the problem of such biased utilization of subpopulations of amplification primers, the present disclosure provides for the first time a template composition and method for standardizing the amplification efficiencies of the members of an oligonucleotide primer set, where the primer set is capable of amplifying rearranged DNA encoding a plurality of adaptive immune receptors (TCR or Ig) in a biological sample that comprises DNA from lymphoid cells. The template composition comprises a plurality of diverse template oligonucleotides of general formula (I) as described in greater detail herein:

$$5'\text{-U1-B1-V-B2-R-B3-J-B4-U2-3'} \quad (1)$$

The constituent template oligonucleotides, of which the template composition is comprised, are diverse with respect to the nucleotide sequences of the individual template oligonucleotides. The individual template oligonucleotides thus may vary in nucleotide sequence considerably from one another as a function of significant sequence variability amongst the large number of possible TCR or BCR variable (V) and joining (J) region polynucleotides. Sequences of individual template oligonucleotide species may also vary from one another as a function of sequence differences in U1, U2, B (B1, B2, B3, and B4) and R oligonucleotides that are included in a particular template within the diverse plurality of templates.

In certain embodiments barcode oligonucleotides B (B1, B2, B3, and B4) may independently and optionally comprise an oligonucleotide barcode sequence, wherein the barcode sequence is selected to identify uniquely a particular paired combination of a particular unique V oligonucleotide sequence and a particular unique J oligonucleotide sequence. The relative positioning of the barcode oligonucleotides B1 and B4 and universal adaptors advantageously permits rapid identification and quantification of the amplification products of a given unique template oligonucleotide by short sequence reads and paired-end sequencing on automated DNA sequencers (e.g., Illumina HiSeg™ or Illumina MiSEQ®, or GeneAnalyzer™-2, Illumina Corp., San Diego, Calif.). In particular, these and related embodiments permit rapid high-throughput determination of specific combinations of a V and a J sequence that are present in an amplification product, thereby to characterize the relative amplification efficiency of each V-specific primer and each J-specific primer that may be present in a primer set which is capable of amplifying rearranged TCR or BCR encoding DNA in a sample. Verification of the identities and/or quantities of the amplification products may be accomplished by longer sequence reads, optionally including sequence reads that extend to B2.

In use, each template oligonucleotide in the plurality of template oligonucleotides is present in a substantially equimolar amount, which in certain preferred embodiments includes preparations in which the molar concentrations of all oligonucleotides are within 1, 2, 3, 4, 5, 6, 7, 8, 9, 10, 11, 12, 13, 14, 15, 16, 17, 18, 19, 20, 21, 22, 23, 24 or 25 percent of each other. In certain other preferred embodiments as provided herein, template olignucleotides are regarded as being present in a substantially equimolar amount when the molar concentrations of all oligonucleotides are within one order of magnitude of each other, including preparations in which the greatest molar concentration that any given unique template oligonucleotide species may have is no more than 1000, 900, 800, 700, 600, 500, 440, 400, 350, 300, 250, 200, 150, 100, 90, 80, 70, 60, 50, 40 or 30 percent greater than the molar concentration at which is present the unique template oligonucleotide species having the lowest concentration in the composition.

In a similar manner, certain embodiments disclosed herein contemplate oligonucleotide primer sets for amplification, in which sets the component primers may be provided in substantially equimolar amounts. As also described herein, according to certain other embodiments, the concentration of one or more primers in a primer set may be adjusted deliberately so that certain primers are not present in equimolar amounts or in substantially equimolar amounts.

The template composition described herein may, in preferred embodiments, be employed as a nucleic acid amplification (e.g., PCR) template to characterize an oligonucleotide primer set, such as the complex sets of V-segment and J-segment oligonucleotide primers that may be used in multiplexed amplification of rearranged TCR or Ig genes, for example, a primer set as provided herein or any of the primer sets described in Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09.001; Sherwood et al. 2011 *Sci. Translat. Med.* 3:90ra61; U.S. application Ser. No. 13/217,126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118, or the like.

Preferably all templates in the template composition for standardizing amplification efficiency, which is described herein and which comprises a plurality of template oligonucleotides having diverse sequences and the general structure of general formula (I), are oligonucleotides of substantially identical length. Without wishing to be bound by theory, it is generally believed that in a nucleic acid amplification reaction such as a polymerase chain reaction (PCR), template DNA length can influence the amplification efficiency of oligonucleotide primers by affecting the kinetics of interactions between primers and template DNA molecules to which the primers anneal by specific, nucleotide sequence-directed hybridization through nucleotide base complementarity. Longer templates are generally regarded as operating less efficiently than relatively shorter templates. In certain embodiments, the presently disclosed template composition for standardizing the amplification efficiency of an oligonucleotide primer set that is capable of amplifying rearranged DNA encoding a plurality of TCR or BCR comprises a plurality of template oligonucleotides of general formula (I) as provided herein, wherein the template oligonucleotides are of an identical length or a substantially identical length that is not more than 1000, 950, 900, 850, 800, 750, 700, 650, 600, 550, 500, 450, 400, 350, 300, 250, 200, 150 or 100 nucleotides in length, including all integer values therebetween.

Accordingly, in order to reduce, remove or minimize the potential contribution to undesirable biases in oligonucleotide primer utilization during multiplexed amplification, preferred embodiments disclosed herein may employ a plurality of template oligonucleotides wherein all template oligonucleotides in the sequence-diverse plurality of template oligonucleotides are of substantially identical length. A plurality of template oligonucleotides may be of substantially identical length when all (e.g., 100%) or most (e.g., greater than 50%) such oligonucleotides in a template composition are oligonucleotides that each have the exact same number of nucleotides, or where one or more template oligonucleotides in the template composition may vary in length from one another by no more than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90 or 100 nucleotides in length. It will be appreciated from the present disclosure that even in situations where not all template oligonucleotides have exactly the same length, the herein described compositions and methods may still be employed to determine and optionally correct non-uniform nucleic acid amplification potential among members of a set of oligonucleotide amplification primers.

According to certain presently disclosed embodiments, (i) each template oligonucleotide of the presently described template composition is provided in a substantially equimolar amount, (ii) the oligonucleotide primer set that is capable of amplifying rearranged DNA encoding a plurality of adaptive immune receptor comprises a plurality of V-segment oligonucleotide primers that are provided in substantially equimolar amounts, (iii) the oligonucleotide primer set that is capable of amplifying rearranged DNA encoding a plurality of adaptive immune receptor comprises a plurality of J-segment oligonucleotide primers that are provided in substantially equimolar amounts, and (iv) amplification scales linearly with the number of starting templates of a given sequence.

Hence, an expected yield for the amplification product of each template can be calculated and arbitrarily assigned a theoretical uniform amplification level value of 100%. After permitting the primer sets to amplify the sequences of the template oligonucleotides in an amplification reaction, any statistically significant deviation from substantial equivalence that is observed among the relative proportions of distinct amplification products indicates that there has been bias (i.e., unequal efficiency) in primer utilization during amplification. In other words, quantitative differences in the relative amounts of different amplification products that are obtained indicate that not all primers in the primer set have amplified their respective templates with comparable efficiencies. Certain embodiments contemplate assigning a range of tolerances above and below a theoretical 100% yield, such that any amplification level value within the range of tolerances may be regarded as substantial equivalence.

In certain such embodiments, the range of amplification product yields may be regarded as substantially equivalent when the product yields are all within the same order of magnitude (e.g., differ by less than a factor of ten). In certain other such embodiments, the range of amplification product yields may be regarded as substantially equivalent when the product yields differ from one another by no more than nine-fold, eight-fold, seven-fold, six-fold, five-fold, four-fold or three-fold. In certain other embodiments, product yields that may be regarded as being within an acceptable tolerance range may be more or less than a calculated 100% yield by as much as 1, 2, 3, 4, 5, 6, 7, 8, 9, 10, 11, 12, 13, 14, 15, 16, 17, 18, 19, 20, 30, 40, 50, 60, 100, or 200%.

Because the method involves determining the nucleotide sequence of each amplification product using known techniques as part of the quantification process, the primer(s) responsible for amplification of each unique (as defined by sequence) product can be identified and their relative amount(s) in the primer set can be adjusted (e.g., increased or decreased in a statistically significant manner) accordingly. The concentrations of excessively efficient primers in the primer set can be reduced relative to the concentrations of other primers, so that the level of specific amplification by such primers of templates in the herein described template composition is substantially equivalent to the level of amplification delivered by the majority of primers which deliver the theoretical uniform amplification level, or which deliver a level that is within the acceptable tolerance range. The concentrations of poorly efficient primers in the primer set can be increased relative to the concentrations of other primers, so that the level of specific amplification by such primers of templates in the herein described template composition is substantially equivalent to the level of amplification delivered by the majority of primers which deliver the theoretical uniform amplification level, or which deliver a level within the acceptable tolerance range.

Accordingly and as described herein, there are thus presently provided a template composition for standardizing the amplification efficiency of an oligonucleotide primer set that is designed to amplify coding sequences for a complete repertoire of a given TCR or Ig chain, a method for determining non-uniform amplification efficiency ("non-uniform amplification potential") among members of such a primer set, and a method for correcting such non-uniform amplification potential. By providing the herein described template composition as a standard with which oligonucleotide primer sets can be calibrated, and in particular embodiments, where each template oligonucleotide is present in a substantially equimolar amount so that individual primer concentrations can be adjusted to yield substantially uniform amplification of a structurally diverse array of amplification products, the present disclosure thus advantageously overcomes the above described problems associated with biases in individual primer efficiency.

Using the compositions and methods provided herein, individual primers may be identified as having a non-uniform amplification potential by virtue of their promotion of non-uniform amplification as evidenced by increased (e.g., greater in a statistically significant manner) or decreased (e.g., lower in a statistically significant manner) amplification of specific template oligonucleotides relative to the uniform amplification level, despite the presence in an amplification reaction (i) of all template oligonucleotides in substantially equimolar amounts to one another, (ii) of all V-segment primers in substantially equimolar amounts to one another, and (iii) of all J-segment primers in substantially equimolar amounts to one another.

The relative concentrations of such primers may then be decreased or increased to obtain a modified complete set of primers in which all primers are not present in substantially equimolar amounts relative to one another, to compensate, respectively, for the increased or decreased level of amplification relative to the uniform amplification level. The primer set may then be retested for its ability to amplify all sequences in the herein disclosed template composition at the uniform amplification level, or within an acceptable tolerance range.

The process of testing modified primer sets for their ability to amplify the herein disclosed template composition, in which all template oligonucleotides are provided in substantially equimolar amounts to one another, may be repeated iteratively until all products are amplified at the uniform amplification level, or within an acceptable tolerance range. By such a process using the herein disclosed template composition, the amplification efficiency of an oligonucleotide primer set may be standardized, where the primer set is capable of amplifying productively rearranged DNA encoding one or a plurality of adaptive immune receptors in a biological sample that comprises DNA from lymphoid cells of a subject.

Additionally or alternatively, according to the present disclosure it may be determined whether any particular pair of oligonucleotide amplification primers exhibits non-uniform amplification potential, such as increased or decreased amplification of the template composition relative to a uniform amplification level exhibited by a majority of the oligonucleotide amplification primers, and a normalizing adjustment factor can then be used to calculate, respectively, a proportionately decreased or increased frequency of occurrence of the amplification products that are promoted by each such amplification primer pair. The present template compositions thus, in certain embodiments, provide a method of correcting for non-uniform nucleic acid amplification potential among members of a set of oligonucleotide amplification primers.

Certain such embodiments may advantageously permit correction, calibration, standardization, normalization, or the like, of data that are obtained as a consequence of non-uniform amplification events. Thus, the present embodiments permit correction of data inaccuracies, such as may result from biased oligonucleotide primer utilization, without the need for iteratively adjusting the concentrations of one or more amplification primers and repeating the steps of amplifying the herein described template compositions. Advantageous efficiencies may thus be obtained where repetition of the steps of quantitatively sequencing the amplification products can be avoided. Certain other contemplated embodiments may, however, employ such an iterative approach.

Accordingly, and as described herein, there is presently provided a template composition for standardizing the amplification efficiency of an oligonucleotide primer set, along with methods for using such a template composition to determine non-uniform nucleic acid amplification potential (e.g., bias) among individual members of the oligonucleotide primer set. Also described herein are methods for correcting such non-uniform nucleic acid amplification potentials (e.g., biases) among members of the oligonucleotide primer set. These and related embodiments exploit previously unrecognized benefits that are obtained by calibrating complex oligonucleotide primer sets to compensate for undesirable amplification biases using the template composition for standardizing amplification efficiency having the features described herein, and will find uses in improving the accuracy with which specific clonotypic TCR and/or Ig encoding DNA sequences can be quantified, relative to previously described methodologies.

As also noted above and described elsewhere herein, prior to the present disclosure there existed unsatisfactory and difficult-to-discern discrepancies between (i) the actual quantitative distribution of rearranged adaptive immune receptor-encoding DNA templates having unique sequences in a biological sample comprising lymphoid cell DNA from a subject, and (ii) the relative representation of nucleic acid amplification products of such templates, following multiplexed amplification using a complex set of oligonucleotide amplification primers designed to amplify substantially all productively rearranged adaptive immune receptor genes in the sample. Due to, e.g., the heterogeneity of both the template population and the amplification primer set, and as shown herein, significant disparities in the amplification efficiencies of different amplification primers may be common, leading to substantial skewing in the relative proportions of amplification products that are obtained and quantitatively sequenced following an amplification reaction.

Templates and Primers

According to certain preferred embodiments there is thus provided a template composition for standardizing the amplification efficiency of an oligonucleotide primer set that is capable of amplifying rearranged DNA (which in certain embodiments may refer to productively rearranged DNA but which in certain other embodiments need not be so limited) encoding one or a plurality of adaptive immune receptors in a biological sample that comprises DNA from lymphoid cells of a subject, the template composition comprising a plurality of template oligonucleotides of general formula (I):

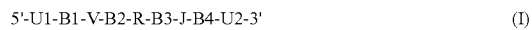

$$5'\text{-}U1\text{-}B1\text{-}V\text{-}B2\text{-}R\text{-}B3\text{-}J\text{-}B4\text{-}U2\text{-}3' \quad (I)$$

as provided herein. In certain preferred embodiments each template oligonucleotide in the plurality of template oligonucleotides is present in a substantially equimolar amount, which in certain embodiments and as noted above may refer to a composition in which each of the template oligonucleotides is present at an equimolar concentration or at a molar concentration that deviates from equimolar by no more than 1, 2, 3, 4, 5, 6, 7, 8, 9, 10, 11, 12, 13, 14, 15, 16, 17, 18, 19, 20, 21, 22, 23, 24, 25, 50, 60, 70, 80, 90, 100 or 200% on a molar basis, and which in certain other embodiments may refer to a composition in which all of the template oligonucleotides are present at molar concentrations that are within an order of magnitude of one another. The plurality of templates may comprise at least 100, 200, 300, 400, 500, 600, 700, 800, 900, 1000, 1100 or more discrete oligonucleotide species each having a distinct nucleotide sequence, including every intermediate integer value therebetween.

The herein disclosed template composition thus comprises a plurality of template oligonucleotides of general formula:

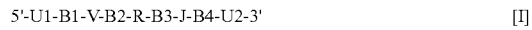

$$5'\text{-}U1\text{-}B1\text{-}V\text{-}B2\text{-}R\text{-}B3\text{-}J\text{-}B4\text{-}U2\text{-}3' \quad (I)$$

wherein, briefly and as elaborated in greater detail elsewhere herein, according to certain preferred embodiments:

V is a polynucleotide comprising at least 20, 30, 60, 90, 120, 150, 180, or 210, and not more than 1000, 900, 800, 700, 600 or 500 contiguous nucleotides of an adaptive immune receptor variable (V) region encoding gene sequence, or the complement thereof, and in each of the plurality of template oligonucleotide sequences V comprises a unique oligonucleotide sequence;

J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of template oligonucleotide sequences J comprises a unique oligonucleotide sequence;

U1 and U2 are each either nothing or each comprise an oligonucleotide having, independently, a sequence that is selected from (i) a universal adaptor oligonucleotide sequence, and (ii) a sequencing platform-specific oligonucleotide sequence that is linked to and positioned 5' to the universal adaptor oligonucleotide sequence;

B1, B2, B3, and B4 are each independently either nothing or each comprise an oligonucleotide B that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 contiguous nucleotides (including all integer values therebetween), wherein in each of the plurality of template oligonucleotide sequences B comprises a unique oligonucleotide sequence that uniquely identifies, or identifies as a paired combination, (i) the unique V oligonucleotide sequence of the template oligonucleotide and (ii) the unique J oligonucleotide sequence of the template oligonucleotide; and R is either nothing or comprises a restriction enzyme recognition site that comprises an oligonucleotide sequence that is absent from V, J, U1, U2, B1, B2, B3, and B4.

In some embodiments, the template oligonucleotide composition comprises additional non-coding or random oligonucleotides. These oligonucleotides may be inserted in various sections between or within the components in the general formula T (5'-U1-B1-V-B2-R-B3-J-B4-U2-3') and be of various lengths in size.

In one embodiment, a is 1 to a number of maximum V gene segments in the mammalian genome of the subject. In another embodiment, b is 1 to a number of maximum J gene segments in the mammalian genome of the subject. In other embodiments, a is 1 or b is 1. In some embodiments, a can range from 1 V gene segment to 54 V gene segments for TCRA, 1-76 V gene segments for TCRB, 1-15 V gene segments for TCRG, 1-7 V gene segments for TCRD, 1-165 V gene segments for IGH, 1-111 for IGK, or 1-79 V gene segments for IGL. In other embodiments, b can range from 1 J gene segment to 61 J gene segments for TCRA, 1-14 J gene segments for TCRB, 1-5 J gene segments for TCRG, 1-4 gene segments for TCRD, 1-9 J gene segments for IGH, 1-5 J gene segments for IGK, or 1-11 J gene segments for IGL.

The table below lists the number of V gene segments (a) and J gene segments (b) for each human adaptive immune receptor loci, including functional V and J segments.

| | V segments* | functional V segments** | J segments* | Functional J segments** |
|---|---|---|---|---|
| TCRA | 54 | 45 | 61 | 50 |
| TCRB | 76 | 48 | 14 | 13 |
| TCRG | 15 | 6 | 5 | 5 |
| TCRD | 7 | 7 | 4 | 4 |
| IGH | 165 | 51 | 9 | 6 |
| IGK | 111 | 44 | 5 | 5 |
| IGL | 79 | 33 | 11 | 7 |

*Total variable and joining segment genes
**Variable and joining segment genes with at least one functional allele In some embodiments, the J polynucleotide comprises at least 15-30, 31-60, 61-90, 91-120, or 120-150, and not more than 600, 500, 400, 300 or 200 contiguous nucleotides of an adaptive immune receptor J constant region, or the complement thereof.

In certain embodiments the plurality of template oligonucleotides comprises at least (a×b) unique oligonucleotide sequences, where a is the number of unique adaptive immune receptor V region-encoding gene segments in a subject and b is the number of unique adaptive immune receptor J region-encoding gene segments in the subject, and the composition comprises at least one template oligonucleotide for every possible combination of a V region-encoding gene segment and a J region-encoding gene segment.

The presently contemplated invention is not intended to be so limited, however, such that in certain embodiments, a substantially fewer number of template oligonucleotides may advantageously be used. In these and related embodiments, where a is the number of unique adaptive immune receptor V region-encoding gene segments in a subject and b is the number of unique adaptive immune receptor J region-encoding gene segments in the subject, the minimum number of unique oligonucleotide sequences of which the plurality of template oligonucleotides is comprised may be determined by whichever is the larger of a and b, so long as each unique V polynucleotide sequence and each unique J polynucleotide sequence is present in at least one template oligonucleotide in the template composition. Thus, according to certain related embodiments the template composition may comprise at least one template oligonucleotide for each unique V polynucleotide, e.g., that includes a single one of each unique V polynucleotide according to general formula (I), and at least one template oligonucleotide for each unique J polynucleotide, e.g., that includes a single one of each unique J polynucleotide according to general formula (I).

In certain other embodiments, the template composition comprises at least one template oligonucleotide to which each oligonucleotide amplification primer in an amplification primer set can anneal.

That is, in certain embodiments, the template composition comprises at least one template oligonucleotide having an oligonucleotide sequence of general formula (I) to which each V-segment oligonucleotide primer can specifically hybridize, and at least one template oligonucleotide having an oligonucleotide sequence of general formula (I) to which each J-segment oligonucleotide primer can specifically hybridize.

According to such embodiments the oligonucleotide primer set that is capable of amplifying rearranged DNA encoding one or a plurality of adaptive immune receptors comprises a plurality a' of unique V-segment oligonucleotide primers and a plurality b' of unique J-segment oligonucleotide primers. The plurality of a' V-segment oligonucleotide primers are each independently capable of annealing or specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one adaptive immune receptor V region-encoding gene segment. The plurality of b' 0.1-segment oligonucleotide primers are each independently capable of annealing or specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one adaptive immune receptor J region-encoding gene segment.

In some embodiments, a' is the same as a (described above for template oligonucleotides). In other embodiments, b' is the same as b (described above for template oligonucleotides).

Thus, in certain embodiments and as also discussed elsewhere herein, the present template composition may be used in amplification reactions with amplification primers that are designed to amplify all rearranged adaptive immune receptor encoding gene sequences, including those that are not expressed, while in certain other embodiments the template composition and amplification primers may be designed so as not to yield amplification products of rearranged genes that are not expressed (e.g., pseudogenes, orphons). It will therefore be appreciated that in certain embodiments only a subset of rearranged adaptive immune receptor encoding genes may desirably be amplified, such that suitable amplification primer subsets may be designed and employed to amplify only those rearranged V–J sequences that are of interest. In these and related embodiments, correspondingly, a herein described template composition comprising only a subset of interest of rearranged V–J rearranged sequences may be used, so long as the template composition comprises at least one template oligonucleotide to which each oligonucleotide amplification primer in an amplification primer set can anneal. The actual number of template oligonucleotides in the template composition may thus vary considerably among the contemplated embodiments, as a function of the amplification primer set that is to be used.

For example, in certain related embodiments, in the template composition the plurality of template oligonucleotides may have a plurality of sequences of general formula (I) that is selected from (1) the plurality of oligonucleotide sequences of general formula (I) in which polynucleotides V and J have the TCRB V and J sequences set forth in at least one set of 68 TCRB V and J SEQ ID NOS, respectively, as set forth in FIGS. 5a-5l as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13; (2) the plurality of oligonucleotide sequences of general formula (I) in which polynucleotides V and J have the TCRG V and J sequences set forth in at least one set of 14 TCRG V and J SEQ ID NOS, respectively, as set forth in FIG. 6 as TCRG V/J set 1, TCRG V/J set 2, TCRG V/J set 3, TCRG V/J set 4 and TCRG V/J set 5; and (3) the plurality of oligonucleotide sequences of general formula (I) in which polynucleotides V and J have the IGH V and J sequences set forth in at least one set of 127 IGH V and J SEQ ID NOS, respectively, as set forth in FIG. 7 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9.

In certain embodiments, V is a polynucleotide sequence that encodes at least 10-70 contiguous amino acids of an adaptive immune receptor V-region, or the complement thereof; J is a polynucleotide sequence that encodes at least 5-30 contiguous amino acids of an adaptive immune receptor J-region, or the complement thereof; U1 and U2 are each either nothing or comprise an oligonucleotide comprising a nucleotide sequence that is selected from (i) a universal adaptor oligonucleotide sequence, and (ii) a sequencing platform-specific oligonucleotide sequence that is linked to and positioned 5' to the universal adaptor oligonucleotide sequence; B1, B2, B3 and B4 are each independently either nothing or each comprise an oligonucleotide B that comprises an oligonucleotide barcode sequence of 3, 4, 5, 6, 7, 8, 9, 10, 11, 12, 13, 14, 15, 16, 17, 18, 19 or 20 contiguous nucleotides, wherein in each of the plurality of oligonucleotide sequences B comprises a unique oligonucleotide sequence that uniquely identifies, as a paired combination, (i) the unique V oligonucleotide sequence and (ii) the unique J oligonucleotide sequence; and R is either nothing or comprises a restriction enzyme recognition site that comprises an oligonucleotide sequence that is absent from V, J, U1, U2, B1, B2, B3, and B4.

In certain preferred embodiments the plurality of template oligonucleotides comprises at least either a or b unique oligonucleotide sequences, where a is the number of unique adaptive immune receptor V region-encoding gene segments in the subject and b is the number of unique adaptive immune receptor J region-encoding gene segments in the subject, and the composition comprises a plurality of template oligonucleotides that comprise at least whichever is the greater of a or b unique template oligonucleotide sequences, provided that at least one V polynucleotide corresponding to each V region-encoding gene segment and at least one J polynucleotide corresponding to each J region-encoding gene segment is included.

A large number of adaptive immune receptor variable (V) region and joining (J) region gene sequences are known as nucleotide and/or amino acid sequences, including non-rearranged genomic DNA sequences of TCR and Ig loci, and productively rearranged DNA sequences at such loci and their encoded products, and also including pseudogenes at these loci, and also including related orphons. See, e.g., U.S. application Ser. No. 13/217,126; U.S. application Ser. No. 12/794,507; PCT/US2011/026373; PCT/US2011/049012. These and other sequences known to the art may be used according to the present disclosure for the design and production of template oligonucleotides to be included in the presently provided template composition for standardizing amplification efficiency of an oligonucleotide primer set, and for the design and production of the oligonucleotide primer set that is capable of amplifying rearranged DNA encoding TCR or Ig polypeptide chains, which rearranged DNA may be present in a biological sample comprising lymphoid cell DNA.

In formula (I), V is a polynucleotide sequence of at least 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400 or 450 and not more than 1000, 900, 800, 700, 600 or 500 contiguous nucleotides of an adaptive immune receptor (e.g., TCR or BCR) variable (V) region gene sequence, or the complement thereof, and in each of the plurality of oligonucleotide sequences V comprises a unique oligonucleotide sequence. Genomic sequences for TCR and BCR V region genes of humans and other species are known and available from public databases such as Genbank; V region gene sequences include polynucleotide sequences that encode the products of expressed, rearranged TCR and BCR genes and also include polynucleotide sequences of pseudogenes that have been identified in the V region loci. The diverse V polynucleotide sequences that may be incorporated into the presently disclosed templates of general formula (I) may vary widely in length, in nucleotide composition (e.g., GC content), and in actual linear polynucleotide sequence, and are known, for example, to include "hot spots" or hypervariable regions that exhibit particular sequence diversity.

The polynucleotide V in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. application Ser. No. 13/217, 126; U.S. application Ser. No. 12/794,507; PCT/US2011/026373; or PCT/US2011/049012; or the like; or as described therein may be designed to include oligonucleotide sequences that can specifically hybridize to each unique V gene and to each J gene in a particular TCR or BCR gene locus (e.g., TCR α, β, γ or γ, or IgH μ, γ, δ, α or ε, or IgL κ or λ). For example by way of illustration and not limitation, an oligonucleotide primer of an oligonucleotide primer amplification set that is capable of amplifying rearranged DNA encoding one or a plurality of TCR or BCR may typically include a nucleotide sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides, or more, and may specifically anneal to a complementary sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides of a V or a J polynucleotide as provided herein. In certain embodiments the primers may comprise at least 19, 20, 21, 22, 23, 24, 25, 26, 27, 28, 29 or 30 nucleotides, and in certain embodiment the primers may comprise sequences of no more than 15, 16, 17, 18, 19, 20, 21, 22, 23, 24, 25, 26, 27, 28, 29, 30, 31, 32, 33, 34, 35, 36, 37, 38, 39 or 40 contiguous nucleotides. Primers and primer annealing sites of other lengths are also expressly contemplated, as disclosed herein.

The entire polynucleotide sequence of each polynucleotide V in general formula (I) may, but need not, consist exclusively of contiguous nucleotides from each distinct V gene. For example and according to certain embodiments, in the template composition described herein, each polynucleotide V of formula (I) need only have at least a region comprising a unique V oligonucleotide sequence that is found in one V gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence) so long as at least one unique V oligonucleotide sequence region (the primer annealing site) is included that is not included in any other template V polynucleotide.

It may be preferred in certain embodiments that the plurality of V polynucleotides that are present in the herein described template composition have lengths that simulate the overall lengths of known, naturally occurring V gene nucleotide sequences, even where the specific nucleotide sequences differ between the template V region and any naturally occurring V gene. The V region lengths in the herein described templates may differ from the lengths of naturally occurring V gene sequences by no more than 1, 2, 3, 4, 5, 6, 7, 8, 9, 10, 11, 12, 13, 14, 15, 16, 17, 18, 19 or 20 percent.

The V polynucleotide in formula (I) may thus, in certain embodiments, comprise a nucleotide sequence having a length that is the same or similar to that of the length of a typical V gene from its start codon to its CDR3 encoding region and may, but need not, include a nucleotide sequence that encodes the CDR3 region. CDR3 encoding nucleotide sequences and sequence lengths may vary considerably and have been characterized by several different numbering schemes (e.g., Lefranc, 1999 *The Immunologist* 7:132; Kabat et al., 1991 *In: Sequences of Proteins of Immunological Interest*, NIH Publication 91-3242; Chothia et al., 1987 *J. Mol. Biol.* 196:901; Chothia et al., 1989 *Nature* 342:877; Al-Lazikani et al., 1997 *J. Mol. Biol.* 273:927; see also, e.g., Rock et al., 1994 *J. Exp. Med.* 179:323; Saada et al., 2007 *Immunol. Cell Biol.* 85:323).

Briefly, the CDR3 region typically spans the polypeptide portion extending from a highly conserved cysteine residue (encoded by the trinucleotide codon TGY; Y=T or C) in the V segment to a highly conserved phenylalanine residue (encoded by TTY) in the J segment of TCRs, or to a highly conserved tryptophan (encoded by TGG) in IGH. More than 90% of natural, productive rearrangements in the TCRB locus have a CDR3 encoding length by this criterion of between 24 and 54 nucleotides, corresponding to between 9 and 17 encoded amino acids. The CDR3 lengths of the presently disclosed synthetic template oligonucleotides should, for any given TCR or BCR locus, fall within the same range as 95% of naturally occurring rearrangements. Thus, for example, in a herein described template composition for standardizing the amplification efficiency of an oligonucleotide primer set that is capable of amplifying rearranged DNA encoding a plurality of TCRB polypeptides, the CDR3 encoding portion of the V polynucleotide may have a length of from 24 to 54 nucleotides, including every integer therebetween. The numbering schemes for CDR3 encoding regions described above denote the positions of the conserved cysteine, phenylalanine and tryptophan codons, and these numbering schemes may also be applied to pseudogenes in which one or more codons encoding these conserved amino acids may have been replaced with a codon encoding a different amino acid. For pseudogenes which do not use these conserved amino acids, the CDR3 length may be defined relative to the corresponding position at which the conserved residue would have been observed absent the substitution, according to one of the established CDR3 sequence position numbering schemes referenced above.

It may also be preferred, in certain embodiments, that the plurality of V polynucleotides that are present in the herein described template composition have nucleotide compositions (e.g., percentage of GC content) that simulate the overall nucleotide compositions of known, naturally occurring V gene sequences, even where the specific nucleotide sequences differ. Such template V region nucleotide compositions may differ from the nucleotide compositions of naturally occurring V gene sequences by no more than 1, 2, 3, 4, 5, 6, 7, 8, 9, 10, 11, 12, 13, 14, 15, 16, 17, 18, 19 or 20 percent. Optionally and according to certain embodiments, the V polynucleotide of the herein described template oligonucleotide includes a stop codon at or near the 3' end of V in general formula (I).

In formula (I) J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of oligonucleotide sequences J comprises a unique oligonucleotide sequence.

The polynucleotide J in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. application Ser. No. 13/217, 126; U.S. application Ser. No. 12/794,507; PCT/US2011/026373; or PCT/US2011/049012; or the like; or as described therein may be designed to include oligonucleotide sequences that can specifically hybridize to each unique V gene and to each unique J gene in a particular TCR or BCR gene locus (e.g., TCR α, β, γ or δ, or IgH μ, γ, δ, α or ε, or IgL κ or λ).

The entire polynucleotide sequence of each polynucleotide J in general formula (I) may, but need not, consist exclusively of contiguous nucleotides from each distinct J gene. For example and according to certain embodiments, in the template composition described herein, each polynucleotide J of formula (I) need only have at least a region comprising a unique J oligonucleotide sequence that is found in one J gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence) so long as at least one unique V oligonucleotide sequence region (the primer annealing site) is included that is not included in any other template J polynucleotide.

It may be preferred in certain embodiments that the plurality of J polynucleotides that are present in the herein described template composition have lengths that simulate the overall lengths of known, naturally occurring J gene nucleotide sequences, even where the specific nucleotide sequences differ between the template J region and any naturally occurring J gene. The J region lengths in the herein described templates may differ from the lengths of naturally occurring J gene sequences by no more than 1, 2, 3, 4, 5, 6, 7, 8, 9, 10, 11, 12, 13, 14, 15, 16, 17, 18, 19 or 20 percent.

The J polynucleotide in formula (I) may thus, in certain embodiments, comprise a nucleotide sequence having a length that is the same or similar to that of the length of a typical naturally occurring J gene and may, but need not, include a nucleotide sequence that encodes the CDR3 region, as discussed above.

Genomic sequences for TCR and BCR J region genes of humans and other species are known and available from public databases such as Genbank; J region gene sequences include polynucleotide sequences that encode the products of expressed and unexpressed rearranged TCR and BCR genes. The diverse J polynucleotide sequences that may be incorporated into the presently disclosed templates of general formula (I) may vary widely in length, in nucleotide composition (e.g., GC content), and in actual linear polynucleotide sequence.

Alternatives to the V and J sequences described herein, for use in construction of the herein described template oligonucleotides and/or V-segment and J-segment oligonucleotide primers, may be selected by a skilled person based on the present disclosure using knowledge in the art regarding published gene sequences for the V- and J-encoding regions of the genes for each TCR and Ig subunit. Reference Genbank entries for human adaptive immune receptor sequences include: TCRα: (TCRA/D): NC_000014.8 (chr14: 22090057 . . . 23021075); TCRβ: (TCRB): NC_000007.13 (chr7:141998851 . . . 142510972); TCRγ: (TCRG): NC_000007.13 (chr7:38279625 . . . 38407656); immunoglobulin heavy chain, IgH (IGH): NC_000014.8 (chr14: 106032614 . . . 107288051); immunoglobulin light chain-kappa, IgLκ (IGK): NC_000002.11 (chr2: 89156874 . . . 90274235); and immunoglobulin light chain-lambda, IgLλ (IGL): NC_000022.10 (chr22: 22380474 . . . 23265085). Reference Genbank entries for mouse adaptive immune receptor loci sequences include: TCRβ: (TCRB): NC_000072.5 (chr6: 40841295 . . . 41508370), and immunoglobulin heavy chain, IgH (IGH): NC_000078.5 (chr12: 114496979 . . . 117248165).

Template and primer design analyses and target site selection considerations can be performed, for example, using the OLIGO primer analysis software and/or the BLASTN 2.0.5 algorithm software (Altschul et al., *Nucleic Acids Res.* 1997, 25(17):3389-402), or other similar programs available in the art.

Accordingly, based on the present disclosure and in view of these known adaptive immune receptor gene sequences and oligonucleotide design methodologies, for inclusion in the instant template oligonucleotides those skilled in the art can design a plurality of V region-specific and J region-specific polynucleotide sequences that each independently contain oligonucleotide sequences that are unique to a given V and J gene, respectively. Similarly, from the present disclosure and in view of known adaptive immune receptor sequences, those skilled in the art can also design a primer set comprising a plurality of V region-specific and J region-specific oligonucleotide primers that are each independently capable of annealing to a specific sequence that is unique to a given V and J gene, respectively, whereby the plurality of primers is capable of amplifying substantially all V genes and substantially all J genes in a given adaptive immune receptor-encoding locus (e.g., a human TCR or IgH locus). Such primer sets permit generation, in multiplexed (e.g., using multiple forward and reverse primer pairs) PCR, of amplification products that have a first end that is encoded by a rearranged V region-encoding gene segment and a second end that is encoded by a J region-encoding gene segment.

Typically and in certain embodiments, such amplification products may include a CDR3-encoding sequence although the invention is not intended to be so limited and contemplates amplification products that do not include a CDR3-encoding sequence. The primers may be preferably designed to yield amplification products having sufficient portions of V and J sequences and/or of V–J barcode (B) sequences as described herein, such that by sequencing the products (amplicons), it is possible to identify on the basis of sequences that are unique to each gene segment (i) the particular V gene, and (ii) the particular J gene in the proximity of which the V gene underwent rearrangement to yield a functional adaptive immune receptor-encoding gene. Typically, and in preferred embodiments, the PCR amplification products will not be more than 600 base pairs in size, which according to non-limiting theory will exclude amplification products from non-rearranged adaptive immune receptor genes. In certain other preferred embodiments the amplification products will not be more than 500, 400, 300, 250, 200, 150, 125, 100, 90, 80, 70, 60, 50, 40, 30 or 20 base pairs in size, such as may advantageously provide rapid, high-throughput quantification of sequence-distinct amplicons by short sequence reads.

In certain preferred embodiments, the plurality of template oligonucleotides comprises at least a or at least b unique oligonucleotide sequences, whichever is larger, where a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide. It will be appreciated that because the template oligonucleotides have a plurality of oligonucleotide sequences of general formula (I), which includes a V polynucleotide and which also includes a J polynucleotide, that the template composition may thus comprise fewer than (a×b) unique oligonucleotide sequences, but will comprise at least the larger of a or b unique oligonucleotide sequences. Accordingly, the composition may accommodate at least one occurrence of each unique V polynucleotide sequence and at least one occurrence of each unique J polynucleotide sequence, where in some instances the at least one occurrence of a particular unique V polynucleotide will be present in the same template oligonucleotide in which may be found the at least one occurrence of a particular unique J polynucleotide. Thus, for example, "at least one template oligonucleotide for each unique V polynucleotide and at least one template oligonucleotide for each unique J polynucleotide" may in certain instances refer to a single template oligonucleotide in which one unique V polynucleotide and one unique J polynucleotide are present.

As also disclosed elsewhere herein, in certain other preferred embodiments the template composition comprises at least one template oligonucleotide to which each oligonucleotide amplification primer in an amplification primer set can anneal. Hence, the composition may comprise fewer than a or b unique sequences, for example, where an amplification primer set may not include a unique primer for every possible V and/or J sequence.

It will be noted that certain embodiments contemplate a template composition for standardizing the amplification efficiency of an oligonucleotide primer set that is capable of amplifying productively rearranged DNA encoding one or a plurality of adaptive immune receptors in a biological sample that comprises DNA from lymphoid cells of a subject as provided herein, wherein the template composition comprises a plurality of template oligonucleotides having a plurality of oligonucleotide sequences of general formula 5'-U1-B1-V-B2-R-B3-J-B4-U2-3' (I) as described herein. According to these and related embodiments and as also described elsewhere herein, the set of oligonucleotide amplification primers that is capable of amplifying productively rearranged DNA may exclude any oligonucleotide primers that specifically hybridize to a V-region pseudogene or orphon or to a J-region pseudogene or orphon. Hence, in such embodiments the template composition will desirably exclude template oligonucleotides of general formula (I) in which unique V oligonucleotide sequences and/or unique J oligonucleotide sequences are sequences that are, respectively, unique to a V-region pseudogene or orphon or to a J-region pseudogene or orphon.

An exemplary TCRB template composition comprising 858 distinct template oligonucleotides is disclosed in the Sequence Listing in SEQ ID NOS:3157-4014. Another exemplary TCRB template composition comprising 871 distinct template oligonucleotides is disclosed in the Sequence Listing in SEQ ID NOS:1-871. Another exemplary TCRB template composition comprising 689 distinct template oligonucleotides is disclosed in the Sequence Listing in SEQ ID NOS:872-1560.

An exemplary TCRG template composition comprising 70 distinct template oligonucleotides is disclosed in the Sequence Listing in SEQ ID NOS:4015-4084. An exemplary TCRG template composition comprising 70 distinct template oligonucleotides is also disclosed in the Sequence Listing in SEQ ID NOS:1561-1630.

An exemplary IGH template composition comprising 1116 distinct template oligonucleotides is disclosed in the Sequence Listing in SEQ ID NOS:4085-5200. An exemplary IGH template composition comprising 1116 distinct template oligonucleotides is also disclosed in the Sequence Listing in SEQ ID NOS:1805-2920.

Also disclosed herein are exemplary sets of V and J polynucleotides for inclusion in the herein described template oligonucleotides having a plurality of oligonucleotide sequences of general formula (I). For TCRB, the plurality of template oligonucleotides may have a plurality of oligonucleotide sequences of general formula (I) in which polynucleotides V and J have the TCRB V and J sequences set forth in at least one set of 68 TCRB V and J SEQ ID NOS, respectively, as set forth in FIG. 5 as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13.

For TCRG, the plurality of template oligonucleotides may have a plurality of oligonucleotide sequences of general formula (I) in which polynucleotides V and J have the TCRG V and J sequences set forth in at least one set of 14 TCRG V and J SEQ ID NOS, respectively, as set forth in FIG. 6 as TCRG V/J set 1, TCRG V/J set 2, TCRG V/J set 3, TCRG V/J set 4 and TCRG V/J set 5.

For IGH, the plurality of template oligonucleotides may have a plurality of oligonucleotide sequences of general formula (I) in which polynucleotides V and J have the IGH V and J sequences set forth in at least one set of 127 IGH V and J SEQ ID NOS, respectively, as set forth in FIG. 7 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9.

Primers

According to the present disclosure, oligonucleotide primers are provided in an oligonucleotide primer set that comprises a plurality of V-segment primers and a plurality of J-segment primers, where the primer set is capable of amplifying rearranged DNA encoding adaptive immune receptors in a biological sample that comprises lymphoid cell DNA. Suitable primer sets are known in the art and disclosed herein, for example, the primer sets in U.S. application Ser. No. 13/217,126; U.S. application Ser. No. 12/794,507; PCT/US2011/026373; or PCT/US2011/049012; or the like; embodiments those shown in Table 1. In certain embodiments the primer set is designed to include a plurality of V sequence-specific primers that includes, for each unique V region gene (including pseudogenes) in a sample, at least one primer that can specifically anneal to a unique V region sequence; and for each unique J region gene in the sample, at least one primer that can specifically anneal to a unique J region sequence.

Primer design may be achieved by routine methodologies in view of known TCR and BCR genomic sequences. Accordingly, the primer set is preferably capable of amplifying every possible V–J combination that may result from DNA rearrangements in the TCR or BCR locus. As also described below, certain embodiments contemplate primer sets in which one or more V primers may be capable of specifically annealing to a "unique" sequence that may be shared by two or more V regions but that is not common to all V regions, and/or in which in which one or more J primers may be capable of specifically annealing to a "unique" sequence that may be shared by two or more J regions but that is not common to all J regions.

In particular embodiments, oligonucleotide primers for use in the compositions and methods described herein may comprise or consist of a nucleic acid of at least about 15 nucleotides long that has the same sequence as, or is complementary to, a 15 nucleotide long contiguous sequence of the target V- or J-segment (i.e., portion of genomic polynucleotide encoding a V-region or J-region polypeptide). Longer primers, e.g., those of about 16, 17, 18, 19, 20, 21, 22, 23, 24, 25, 26, 27, 28, 29, 30, 31, 32, 33, 34, 35, 36, 37, 38, 39, 40, 45, or 50, nucleotides long that have the same sequence as, or sequence complementary to, a contiguous sequence of the target V- or J-region encoding polynucleotide segment, will also be of use in certain embodiments. All intermediate lengths of the presently described oligonucleotide primers are contemplated for use herein. As would be recognized by the skilled person, the primers may have additional sequence added (e.g., nucleotides that may not be the same as or complementary to the target V- or J-region encoding polynucleotide segment), such as restriction enzyme recognition sites, adaptor sequences for sequencing, bar code sequences, and the like (see e.g., primer sequences provided in the Tables and sequence listing herein). Therefore, the length of the primers may be longer, such as about 55, 56, 57, 58, 59, 60, 61, 62, 63, 64, 65, 66, 67, 68, 69, 70, 71, 72, 73, 74, 75, 80, 85, 90, 95, 100 or more nucleotides in length or more, depending on the specific use or need.

Also contemplated for use in certain embodiments are adaptive immune receptor V-segment or J-segment oligonucleotide primer variants that may share a high degree of sequence identity to the oligonucleotide primers for which nucleotide sequences are presented herein, including those set forth in the Sequence Listing. Thus, in these and related embodiments, adaptive immune receptor V-segment or J-segment oligonucleotide primer variants may have substantial identity to the adaptive immune receptor V-segment or J-segment oligonucleotide primer sequences disclosed herein, for example, such oligonucleotide primer variants may comprise at least 70% sequence identity, preferably at least 75%, 80%, 85%, 90%, 91%, 92%, 93%, 94%, 95%, 96%, 97%, 98%, or 99% or higher sequence identity compared to a reference polynucleotide sequence such as the oligonucleotide primer sequences disclosed herein, using the methods described herein (e.g., BLAST analysis using standard parameters). One skilled in this art will recognize that these values can be appropriately adjusted to determine corresponding ability of an oligonucleotide primer variant to anneal to an adaptive immune receptor segment-encoding polynucleotide by taking into account codon degeneracy, reading frame positioning and the like.

Typically, oligonucleotide primer variants will contain one or more substitutions, additions, deletions and/or insertions, preferably such that the annealing ability of the variant oligonucleotide is not substantially diminished relative to that of an adaptive immune receptor V-segment or J-segment oligonucleotide primer sequence that is specifically set forth herein.

Table 1 presents as a non-limiting example an oligonucleotide primer set that is capable of amplifying productively rearranged DNA encoding TCR β-chains (TCRB) in a biological sample that comprises DNA from lymphoid cells of a subject. In this primer set the J segment primers share substantial sequence homology, and therefore may cross-prime amongst more than one target J polynucleotide sequence, but the V segment primers are designed to anneal specifically to target sequences within the CDR2 region of V and are therefore unique to each V segment. An exception, however, is present in the case of several V primers where the within-family sequences of the closely related target genes are identical (e.g., V6-2 and V6-3 are identical at the nucleotide level throughout the coding sequence of the V segment, and therefore may have a single primer, TRB2V6-2/3).

It will therefore be appreciated that in certain embodiments the number of different template oligonucleotides in the template composition, and/or the number of different oligonucleotide primers in the primer set, may be advantageously reduced by designing template and/or primers to exploit certain known similarities in V and/or J sequences. Thus, in these and related embodiments, "unique" oligonucleotide sequences as described herein may include specific V polynucleotide sequences that are shared by 1, 2, 3, 4, 5, 6, 7, 8, 9, 10, 11, 12, 13, 14, 15, 16, 17, 18, 19 or 20 distinct template oligonucleotides and/or specific J polynucleotide sequences that are shared by 1, 2, 3, 4, 5, 6, 7, 8, 9, 10, 11, 12 or 13 distinct template oligonucleotides, where such templates differ in sequence from one another by other than the shared V and/or J sequences.

According to certain presently contemplated embodiments, it may be useful to decrease (e.g., reduce in a statistically significant manner) template amplification bias such as non-uniform nucleic acid amplification potential among members of a set of amplification primers that can result from unequal primer efficiencies (e.g., unequal primer utilization) only for a limited subset of all naturally occurring V and J genes. For example, in analyses of the TCR or BCR immune repertoire involved in an immune response, whether to a specific antigen, as in a vaccine, or to a tissue, as in an autoimmune disease, only the productive TCR or IG rearrangements may be of interest. In such circumstances, it may be economically advantageous to identify and correct non-uniform nucleic acid amplification potential only for those V and J segment primers that contribute to productive rearrangements of TCR or BCR encoding DNA, and to exclude efforts to correct non-uniform amplification of pseudogenes and orphons (i.e., TCR or BCR V region-encoding segments that have been duplicated onto other chromosomes).

In the human IGH locus, for instance, the ImmunoGeneTics (IMGT) database (M.-P. LeFranc, Université Montpellier, Montpellier, France; www.imgt.org) annotates 165 V segment genes, of which 26 are orphons on other chromosomes and 139 are in the IGH locus at chromosome 14. Among the 139 V segments within the IGH locus, 51 have at least one functional allele, while 6 are ORFs (open-reading frames) which are missing at least one highly conserved amino-acid residue, and 81 are pseudogenes. Pseudogenes may include V segments that contain an in-frame stop codon within the V-segment coding sequence, a frameshift between the start codon and the CDR3 encoding sequence, one or more repeat-element insertions, and deletions of critical regions, such as the first exon or the RSS. To characterize functional IGH rearrangements in a sample while avoiding the time and expense of characterizing pseudogenes and/or orphons, it is therefore contemplated to use a subset of the herein described synthetic template oligonucleotides which is designed to include only those V segments that participate in a functional rearrangement to encode a TCR or BCR, without having to synthesize or calibrate amplification primers and template oligonucleotides specific to the pseudogene sequences. Advantageous efficiencies with respect, inter alia, to time and expense are thus obtained.

TABLE 1

Exemplary Oligonucleotide Primer Set (hsTCRB PCR Primers)

| Name | Sequence | SEQ ID NO: |
|---|---|---|
| TRBJ1-1 | TTACCTACAACTGTGAGTCTGGTGCCTTGTCCAAA | 1631 |
| TRBJ1-2 | ACCTACAACGGTTAACCTGGTCCCCGAACCGAA | 1632 |
| TRBJ1-3 | ACCTACAACAGTGAGCCAACTTCCCTCTCCAAA | 1633 |
| TRBJ1-4 | CCAAGACAGAGAGCTGGGTTCCACTGCCAAA | 1634 |
| TRBJ1-5 | ACCTAGGATGGAGAGTCGAGTCCCATCACCAAA | 1635 |
| TRBJ1-6 | CTGTCACAGTGAGCCTGGTCCCGTTCCCAAA | 1636 |
| TRBJ2-1 | CGGTGAGCCGTGTCCCTGGCCCGAA | 1637 |
| TRBJ2-2 | CCAGTACGGTCAGCCTAGAGCCTTCTCCAAA | 1638 |
| TRBJ2-3 | ACTGTCAGCCGGGTGCCTGGGCCAAA | 1639 |
| TRBJ2-4 | AGAGCCGGGTCCCGGCGCCGAA | 1640 |
| TRBJ2-5 | GGAGCCGCGTGCCTGGCCCGAA | 1641 |

TABLE 1-continued

Exemplary Oligonucleotide Primer Set (hsTCRB PCR Primers)

| Name | Sequence | SEQ ID NO: |
|---|---|---|
| TRBJ2-6 | GTCAGCCTGCTGCCGGCCCCGAA | 1642 |
| TRBJ2-7 | GTGAGCCTGGTGCCCGGCCCGAA | 1643 |
| TRB2V10-1 | AACAAAGGAGAAGTCTCAGATGGCTACAG | 1644 |
| TRB2V10-2 | GATAAAGGAGAAGTCCCCGATGGCTATGT | 1645 |
| TRB2V10-3 | GACAAAGGAGAAGTCTCAGATGGCTATAG | 1646 |
| TRB2V6-2/3 | GCCAAAGGAGAGGTCCCTGATGGCTACAA | 1647 |
| TRB2V6-8 | CTCTAGATTAAACACAGAGGATTTCCCAC | 1648 |
| TRB2V6-9 | AAGGAGAAGTCCCCGATGGCTACAATGTA | 1649 |
| TRB2V6-5 | AAGGAGAAGTCCCCAATGGCTACAATGTC | 1650 |
| TRB2V6-6 | GACAAAGGAGAAGTCCCGAATGGCTACAAC | 1651 |
| TRB2V6-7 | GTTCCCAATGGCTACAATGTCTCCAGATC | 1652 |
| TRB2V6-1 | GTCCCCAATGGCTACAATGTCTCCAGATT | 1653 |
| TRB2V6-4 | GTCCCTGATGGTTATAGTGTCTCCAGAGC | 1654 |
| TRB2V24-1 | ATCTCTGATGGATACAGTGTCTCTCGACA | 1655 |
| TRB2V25-1 | TTTCCTCTGAGTCAACAGTCTCCAGAATA | 1656 |
| TRB2V27 | TCCTGAAGGGTACAAAGTCTCTCGAAAAG | 1657 |
| TRB2V26 | CTCTGAGAGGTATCATGTTTCTTGAAATA | 1658 |
| TRB2V28 | TCCTGAGGGGTACAGTGTCTCTAGAGAGA | 1659 |
| TRB2V19 | TATAGCTGAAGGGTACAGCGTCTCTCGGG | 1660 |
| TRB2V4-1 | CTGAATGCCCCAACAGCTCTCTCTTAAAC | 1661 |
| TRB2V4-2/3 | CTGAATGCCCCAACAGCTCTCTCTTAAAC | 1662 |
| TRB2V2P | CCTGAATGCCCTGACAGCTCTCGCTTATA | 1663 |
| TRB2V3-1 | CCTAAATCTCCAGACAAAGCTCACTTAAA | 1664 |
| TRB2V3-2 | CTCACCTGACTCTCCAGACAAAGCTCAT | 1665 |
| TRB2V16 | TTCAGCTAAGTGCCTCCCAAATTCACCCT | 1666 |
| TRB2V23-1 | GATTCTCATCTCAATGCCCCAAGAACGC | 1667 |
| TRB2V18 | ATTTTCTGCTGAATTTCCCAAAGAGGGCC | 1668 |
| TRB2V17 | ATTCACAGCTGAAAGACCTAACGGAACGT | 1669 |
| TRB2V14 | TCTTAGCTGAAAGGACTGGAGGGACGTAT | 1670 |
| TRB2V2 | TTCGATGATCAATTCTCAGTTGAAAGGCC | 1671 |
| TRB2V12-1 | TTGATTCTCAGCACAGATGCCTGATGT | 1672 |
| TRB2V12-2 | GCGATTCTCAGCTGAGAGGCCTGATGG | 1673 |
| TRB2V12-3/4 | TCGATTCTCAGCTAAGATGCCTAATGC | 1674 |
| TRB2V12-5 | TTCTCAGCAGAGATGCCTGATGCAACTTTA | 1675 |
| TRB2V7-9 | GGTTCTCTGCAGAGAGGCCTAAGGGATCT | 1676 |
| TRB2V7-8 | GCTGCCCAGTGATCGCTTCTTTGCAGAAA | 1677 |
| TRB2V7-4 | GGCGGCCCAGTGGTCGGTTCTCTGCAGAG | 1678 |
| TRB2V7-6/7 | ATGATCGGTTCTCTGCAGAGAGGCCTGAGG | 1679 |
| TRB2V7-2 | AGTGATCGCTTCTCTGCAGAGAGGACTGG | 1680 |
| TRB2V7-3 | GGCTGCCCAACGATCGGTTCTTTGCAGT | 1681 |
| TRB2V7-1 | TCCCCGTGATCGGTTCTCTGCACAGAGGT | 1682 |
| TRB2V11-123 | CTAAGGATCGATTTTCTGCAGAGAGGCTC | 1683 |
| TRB2V13 | CTGATCGATTCTCAGCTCAACAGTTCAGT | 1684 |
| TRB2V5-1 | TGGTCGATTCTCAGGGCGCCAGTTCTCTA | 1685 |
| TRB2V5-3 | TAATCGATTCTCAGGGCGCCAGTTCCATG | 1686 |
| TRB2V5-4 | TCCTAGATTCTCAGGTCTCCAGTTCCCTA | 1687 |
| TRB2V5-8 | GGAAACTTCCCTCCTAGATTTTCAGGTCG | 1688 |
| TRB2V5-5 | AAGAGGAAACTTCCCTGATCGATTCTCAGC | 1689 |
| TRB2V5-6 | GGCAACTTCCCTGATCGATTCTCAGGTCA | 1690 |
| TRB2V9 | GTTCCCTGACTTGCACTCTGAACTAAAC | 1691 |
| TRB2V15 | GCCGAACACTTCTTTCTGCTTTCTTGAC | 1692 |
| TRB2V30 | GACCCCAGGACCGGCAGTTCATCCTGAGT | 1693 |
| TRB2V20-1 | ATGCAAGCCTGACCTTGTCCACTCTGACA | 1694 |
| TRB2V29-1 | CATCAGCCGCCCAAACCTAACATTCTCAA | 1695 |

In certain embodiments, the V-segment and J-segment oligonucleotide primers as described herein are designed to include nucleotide sequences such that adequate information is present within the sequence of an amplification product of a rearranged adaptive immune receptor (TCR or Ig) gene to identify uniquely both the specific V and the specific J genes that give rise to the amplification product in the rearranged adaptive immune receptor locus (e.g., at least 1, 2, 3, 4, 5, 6, 7, 8, 9, 10, 11, 12, 13, 14, 15, 16, 17, 18, 19 or 20 base pairs of sequence upstream of the V gene recombination signal sequence (RSS), preferably at least about 22, 24, 26, 28, 30, 32, 34, 35, 36, 37, 38, 39 or 40 base pairs of sequence upstream of the V gene recombination signal sequence (RSS), and in certain preferred embodiments greater than 40 base pairs of sequence upstream of the V gene recombination signal sequence (RSS), and at least 1, 2, 3, 4, 5, 6, 7, 8, 9, 10, 11, 12, 13, 14, 15, 16, 17, 18, 19 or 20 base pairs downstream of the J gene RSS, preferably at least about 22, 24, 26, 28 or 30 base pairs downstream of the J gene RSS, and in certain preferred embodiments greater than 30 base pairs downstream of the J gene RSS).

This feature stands in contrast to oligonucleotide primers described in the art for amplification of TCR-encoding or Ig-encoding gene sequences, which rely primarily on the amplification reaction merely for detection of presence or absence of products of appropriate sizes for V and J segments (e.g., the presence in PCR reaction products of an amplicon of a particular size indicates presence of a V or J segment but fails to provide the sequence of the amplified PCR product and hence fails to confirm its identity, such as the common practice of spectratyping).

Oligonucleotides (e.g., primers) can be prepared by any suitable method, including direct chemical synthesis by a method such as the phosphotriester method of Narang et al., 1979, *Meth. Enzymol.* 68:90-99; the phosphodiester method of Brown et al., 1979, *Meth. Enzymol.* 68:109-151; the diethylphosphoramidite method of Beaucage et al., 1981, *Tetrahedron Lett.* 22:1859-1862; and the solid support method of U.S. Pat. No. 4,458,066, each incorporated herein by reference. A review of synthesis methods of conjugates of oligonucleotides and modified nucleotides is provided in Goodchild, 1990, *Bioconjugate Chemistry* 1(3): 165-187, incorporated herein by reference.

The term "primer," as used herein, refers to an oligonucleotide capable of acting as a point of initiation of DNA synthesis under suitable conditions. Such conditions include those in which synthesis of a primer extension product complementary to a nucleic acid strand is induced in the presence of four different nucleoside triphosphates and an agent for extension (e.g., a DNA polymerase or reverse transcriptase) in an appropriate buffer and at a suitable temperature.

A primer is preferably a single-stranded DNA. The appropriate length of a primer depends on the intended use of the primer but typically ranges from 6 to 50 nucleotides, or in certain embodiments, from 15-35 nucleotides. Short primer molecules generally require cooler temperatures to form sufficiently stable hybrid complexes with the template. A primer need not reflect the exact sequence of the template nucleic acid, but must be sufficiently complementary to hybridize with the template. The design of suitable primers for the amplification of a given target sequence is well known in the art and described in the literature cited herein.

As described herein, primers can incorporate additional features which allow for the detection or immobilization of the primer but do not alter the basic property of the primer, that of acting as a point of initiation of DNA synthesis. For example, primers may contain an additional nucleic acid sequence at the 5' end which does not hybridize to the target nucleic acid, but which facilitates cloning, detection, or sequencing of the amplified product. The region of the primer which is sufficiently complementary to the template to hybridize is referred to herein as the hybridizing region.

As used herein, a primer is "specific," for a target sequence if, when used in an amplification reaction under sufficiently stringent conditions, the primer hybridizes primarily to the target nucleic acid. Typically, a primer is specific for a target sequence if the primer-target duplex stability is greater than the stability of a duplex formed between the primer and any other sequence found in the sample. One of skill in the art will recognize that various factors, such as salt conditions as well as base composition of the primer and the location of the mismatches, will affect the specificity of the primer, and that routine experimental confirmation of the primer specificity will be needed in many cases. Hybridization conditions can be chosen under which the primer can form stable duplexes only with a target sequence. Thus, the use of target-specific primers under suitably stringent amplification conditions enables the selective amplification of those target sequences which contain the target primer binding sites.

In particular embodiments, primers for use in the methods described herein comprise or consist of a nucleic acid of at least about 15 nucleotides long that has the same sequence as, or is complementary to, a 15 nucleotide long contiguous sequence of the target V or J segment. Longer primers, e.g., those of about 16, 17, 18, 19, 20, 21, 22, 23, 24, 25, 26, 27, 28, 29, 30, 31, 32, 33, 34, 35, 36, 37, 38, 39, 40, 45, or 50, nucleotides long that have the same sequence as, or sequence complementary to, a contiguous sequence of the target V or J segment, will also be of use in certain embodiments. All intermediate lengths of the aforementioned primers are contemplated for use herein. As would be recognized by the skilled person, the primers may have additional sequence added (e.g., nucleotides that may not be the same as or complementary to the target V or J segment), such as restriction enzyme recognition sites, adaptor sequences for sequencing, bar code sequences, and the like (see e.g., primer sequences provided herein and in the sequence listing). Therefore, the length of the primers may be longer, such as 55, 56, 57, 58, 59, 60, 65, 70, 75, nucleotides in length or more, depending on the specific use or need. For example, in one embodiment, the forward and reverse primers are both modified at the 5' end with the universal forward primer sequence compatible with a DNA sequencer.

Also contemplated for use in certain embodiments are adaptive immune receptor V-segment or J-segment oligonucleotide primer variants that may share a high degree of sequence identity to the oligonucleotide primers for which nucleotide sequences are presented herein, including those set forth in the Sequence Listing. Thus, in these and related embodiments, adaptive immune receptor V-segment or J-segment oligonucleotide primer variants may have substantial identity to the adaptive immune receptor V-segment or J-segment oligonucleotide primer sequences disclosed herein, for example, such oligonucleotide primer variants may comprise at least 70% sequence identity, preferably at least 75%, 80%, 85%, 90%, 91%, 92%, 93%, 94%, 95%, 96%, 97%, 98%, or 99% or higher sequence identity compared to a reference polynucleotide sequence such as the oligonucleotide primer sequences disclosed herein, using the methods described herein (e.g., BLAST analysis using standard parameters). One skilled in this art will recognize that these values can be appropriately adjusted to determine corresponding ability of an oligonucleotide primer variant to anneal to an adaptive immune receptor segment-encoding polynucleotide by taking into account codon degeneracy, reading frame positioning and the like.

Typically, oligonucleotide primer variants will contain one or more substitutions, additions, deletions and/or insertions, preferably such that the annealing ability of the variant oligonucleotide is not substantially diminished relative to that of an adaptive immune receptor V-segment or J-segment oligonucleotide primer sequence that is specifically set forth herein. As also noted elsewhere herein, in preferred embodiments adaptive immune receptor V-segment and J-segment oligonucleotide primers are designed to be capable of amplifying a rearranged TCR or IGH sequence that includes the coding region for CDR3.

According to certain embodiments contemplated herein, the primers for use in the multiplex PCR methods of the present disclosure may be functionally blocked to prevent non-specific priming of non-T or B cell sequences. For example, the primers may be blocked with chemical modifications as described in U.S. patent application publication US2010/0167353. According to certain herein disclosed embodiments, the use of such blocked primers in the present multiplex PCR reactions involves primers that may have an inactive configuration wherein DNA replication (i.e., primer extension) is blocked, and an activated configuration wherein DNA replication proceeds. The inactive configuration of the primer is present when the primer is either single-stranded, or when the primer is specifically hybridized to the target DNA sequence of interest but primer extension remains blocked by a chemical moiety that is linked at or near to the 3' end of the primer.

The activated configuration of the primer is present when the primer is hybridized to the target nucleic acid sequence of interest and is subsequently acted upon by RNase H or another cleaving agent to remove the 3' blocking group, thereby allowing an enzyme (e.g., a DNA polymerase) to catalyze primer extension in an amplification reaction. Without wishing to be bound by theory, it is believed that the kinetics of the hybridization of such primers are akin to a second order reaction, and are therefore a function of the T cell or B cell gene sequence concentration in the mixture. Blocked primers minimize non-specific reactions by requiring hybridization to the target followed by cleavage before primer extension can proceed. If a primer hybridizes incorrectly to a sequence that is related to the desired target sequence but which differs by having one or more non-complementary nucleotides that result in base-pairing mismatches, cleavage of the primer is inhibited, especially when there is a mismatch that lies at or near the cleavage site. This strategy to improve the fidelity of amplification reduces the frequency of false priming at such locations, and thereby increases the specificity of the reaction. As would be recognized by the skilled person, reaction conditions, particularly the concentration of RNase H and the time allowed for hybridization and extension in each cycle, can be optimized to maximize the difference in cleavage efficiencies between highly efficient cleavage of the primer when it is correctly hybridized to its true target sequence, and poor cleavage of the primer when there is a mismatch between the primer and the template sequence to which it may be incompletely annealed.

As described in US2010/0167353, a number of blocking groups are known in the art that can be placed at or near the 3' end of the oligonucleotide (e.g., a primer) to prevent extension. A primer or other oligonucleotide may be modified at the 3'-terminal nucleotide to prevent or inhibit initiation of DNA synthesis by, for example, the addition of a 3' deoxyribonucleotide residue (e.g., cordycepin), a 2',3'-dideoxyribonucleotide residue, non-nucleotide linkages or alkane-diol modifications (U.S. Pat. No. 5,554,516). Alkane diol modifications which can be used to inhibit or block primer extension have also been described by Wilk et al., (1990 Nucleic Acids Res. 18 (8):2065), and by Arnold et al. (U.S. Pat. No. 6,031, 091). Additional examples of suitable blocking groups include 3' hydroxyl substitutions (e.g., 3'-phosphate, 3'-triphosphate or 3'-phosphate diesters with alcohols such as 3-hydroxypropyl), 2'3'-cyclic phosphate, 2' hydroxyl substitutions of a terminal RNA base (e.g., phosphate or sterically bulky groups such as triisopropyl silyl (TIPS) or tert-butyl dimethyl silyl (TBDMS)). 2'-alkyl silyl groups such as TIPS and TBDMS substituted at the 3'-end of an oligonucleotide are described by Laikhter et al., U.S. patent application Ser. No. 11/686,894, which is incorporated herein by reference. Bulky substituents can also be incorporated on the base of the 3'-terminal residue of the oligonucleotide to block primer extension.

In certain embodiments, the oligonucleotide may comprise a cleavage domain that is located upstream (e.g., 5' to) of the blocking group used to inhibit primer extension. As examples, the cleavage domain may be an RNase H cleavage domain, or the cleavage domain may be an RNase H2 cleavage domain comprising a single RNA residue, or the oligonucleotide may comprise replacement of the RNA base with one or more alternative nucleosides. Additional illustrative cleavage domains are described in US2010/0167353.

Thus, a multiplex PCR system may use 40, 45, 50, 55, 60, 65, 70, 75, 80, 85, or more forward primers, wherein each forward primer is complementary to a single functional TCR or Ig V segment or a small family of functional TCR or Ig V segments, e.g., a TCR VP segment, (see e.g., the TCRBV primers as shown in Table 1, SEQ ID NOS:1644-1695), and, for example, thirteen reverse primers, each specific to a TCR or Ig J segment, such as TCR Jβ segment (see e.g., TCRBJ primers in Table 1, SEQ ID NOS:1631-1643). In another embodiment, a multiplex PCR reaction may use four forward primers each specific to one or more functional TCRγ V segment and four reverse primers each specific for one or more TCRγ J segments. In another embodiment, a multiplex PCR reaction may use 84 forward primers each specific to one or more functional V segments and six reverse primers each specific for one or more J segments.

Thermal cycling conditions may follow methods of those skilled in the art. For example, using a PCR Express™ thermal cycler (Hybaid, Ashford, UK), the following cycling conditions may be used: 1 cycle at 95° C. for 15 minutes, 25 to 40 cycles at 94° C. for 30 seconds, 59° C. for 30 seconds and 72° C. for 1 minute, followed by one cycle at 72° C. for 10 minutes. As will be recognized by the skilled person, thermal cycling conditions may be optimized, for example, by modifying annealing temperatures, annealing times, number of cycles and extension times. As would be recognized by the skilled person, the amount of primer and other PCR reagents used, as well as PCR parameters (e.g., annealing temperature, extension times and cycle numbers), may be optimized to achieve desired PCR amplification efficiency.

Alternatively, in certain related embodiments also contemplated herein, "digital PCR" methods can be used to quantitate the number of target genomes in a sample, without the need for a standard curve. In digital PCR, the PCR reaction for a single sample is performed in a multitude of more than 100 microcells or droplets, such that each droplet either amplifies (e.g., generation of an amplification product provides evidence of the presence of at least one template molecule in the microcell or droplet) or fails to amplify (evidence that the template was not present in a given microcell or droplet). By simply counting the number of positive microcells, it is possible directly to count the number of target genomes that are present in an input sample.

Digital PCR methods typically use an endpoint readout, rather than a conventional quantitative PCR signal that is measured after each cycle in the thermal cycling reaction (see, e.g., Pekin et al., 2011 Lab. Chip 11(13):2156; Zhong et al., 2011 Lab. Chip 11(13):2167; Tewhey et al., 2009 Nature Biotechnol. 27:1025; 2010 Nature Biotechnol. 28:178; Vogelstein and Kinzler, 1999 Proc. Natl. Acad. Sci. USA 96:9236-41; Pohl and Shih, 2004 Expert Rev. Mol. Diagn. 4(1);41-7, 2004). Compared with traditional PCR, dPCR has the following advantages: (1) there is no need to rely on references or standards, (2) desired precision may be achieved by increasing the total number of PCR replicates, (3) it is highly tolerant to inhibitors, (4) it is capable of analyzing complex mixtures, and (5) it provides a linear response to the number of copies present in a sample to allow for small change in the copy number to be detected. Accordingly, any of the herein described compositions (e.g., template compositions and adaptive immune receptor gene-specific oligonucleotide primer sets) and methods may be adapted for use in such digital PCR methodology, for example, the ABI QuantStudio™ 12K Flex System (Life Technologies, Carlsbad, Calif.), the QX100™ Droplet Digital™ PCR system (BioRad, Hercules, Calif.), the QuantaLife™ digital PCR system (BioRad, Hercules, Calif.) or the RainDance™ microdroplet digital PCR system (RainDance Technologies, Lexington, Mass.).

Adaptors

The herein described template oligonucleotides of general formula (I) also may in certain embodiments comprise first (U1) and second (U2) universal adaptor oligonucleotide sequences, or may lack either or both of U1 and U2. U1 thus may comprise either nothing or an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence, and U2 may comprise either nothing or an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence.

U1 and/or U2 may, for example, comprise universal adaptor oligonucleotide sequences and/or sequencing platform-specific oligonucleotide sequences that are specific to a single-molecule sequencing technology being employed, for example the HiSeq™ or GeneAnalyzer™-2 (GA-2) systems (Illumina, Inc., San Diego, Calif.) or another suitable sequencing suite of instrumentation, reagents and software. Inclusion of such platform-specific adaptor sequences permits direct quantitative sequencing of the presently described template composition, which comprises a plurality of different template oligonucleotides of general formula (I), using a nucleotide sequencing methodology such as the HiSeq™ or GA2 or equivalent. This feature therefore advantageously permits qualitative and quantitative characterization of the template composition.

In particular, the ability to sequence all components of the template composition directly allows for verification that each template oligonucleotide in the plurality of template oligonucleotides is present in a substantially equimolar amount. For example, a set of the presently described template oligonucleotides may be generated that have universal adaptor sequences at both ends, so that the adaptor sequences can be used to further incorporate sequencing platform-specific oligonucleotides at each end of each template.

Without wishing to be bound by theory, platform-specific oligonucleotides may be added onto the ends of such modified templates using 5' (5 '-platform sequence-universal adaptor-1 sequence-3') and 3' (5'-platform sequence-universal adaptor-2 sequence-3') oligonucleotides in as little as two cycles of denaturation, annealing and extension, so that the relative representation in the template composition of each of the component template oligonucleotides is not quantitatively altered. Unique identifier sequences (e.g., barcode sequences B comprising unique V and B oligonucleotide sequences that are associated with and thus identify, respectively, individual V and J regions, as described herein) are placed adjacent to the adaptor sequences, thus permitting quantitative sequencing in short sequence reads, in order to characterize the template population by the criterion of the relative amount of each unique template sequence that is present.

Where such direct quantitative sequencing indicates that one or more particular oligonucleotides may be over- or underrepresented in a preparation of the template composition, adjustment of the template composition can be made accordingly to obtain a template composition in which all oligonucleotides are present in substantially equimolar amounts. The template composition in which all oligonucleotides are present in substantially equimolar amounts may then be used as a calibration standard for amplification primer sets, such as in the presently disclosed methods for determining and correcting non-uniform amplification potential among members of a primer set.

In addition to adaptor sequences described in the Examples and included in the exemplary template sequences in the Sequence Listing (e.g., at the 5' and 3' ends of SEQ ID NOS: 1-1630), other oligonucleotide sequences that may be used as universal adaptor sequences will be known to those familiar with the art in view of the present disclosure, including selection of adaptor oligonucleotide sequences that are distinct from sequences found in other portions of the herein described templates. Non-limiting examples of additional adaptor sequences are shown in Table 2 and set forth in SEQ ID NOS:1710-1731.

TABLE 2

Exemplary Adaptor Sequences

| Adaptor (primer) name | Sequence | SEQ ID NO: |
|---|---|---|
| T7 Promotor | AATACGACTCACTATAGG | 1710 |
| T7 Terminator | GCTAGTTATTGCTCAGCGG | 1711 |
| T3 | ATTAACCCTCACTAAAGG | 1712 |
| SP6 | GATTTAGGTGACACTATAG | 1713 |
| M13F(-21) | TGTAAAACGACGGCCAGT | 1714 |
| M13F(-40) | GTTTTCCCAGTCACGAC | 1715 |
| M13R Reverse | CAGGAAACAGCTATGACC | 1716 |
| AOX1 Forward | GACTGGTTCCAATTGACAAGC | 1717 |
| AOX1 Reverse | GCAAATGGCATTCTGACATCC | 1718 |
| pGEX Forward (GST 5, pGEX 5') | GGGCTGGCAAGCCACGTTTGGTG | 1719 |
| pGEX Reverse (GST 3, pGEX 3') | CCGGGAGCTGCATGTGTCAGAGG | 1720 |

TABLE 2-continued

Exemplary Adaptor Sequences

| Adaptor (primer) name | Sequence | SEQ ID NO: |
|---|---|---|
| BGH Reverse | AACTAGAAGGCACAGTCGAGGC | 1721 |
| GFP (C' terminal, CFP, YFP or BEP) | CACTCTCGGCATGGACGAGC | 1772 |
| GFP Reverse | TGGTGCAGATGAACTTCAGG | 1723 |
| GAG | GTTCGACCCCGCCTCGATCC | 1724 |
| GAG Reverse | TGACACACATTCCACAGGGTC | 1725 |
| CYC1 Reverse | GCGTGAATGTAAGCGTGAC | 1726 |
| pFastBacF | 5'-d (GGATTATTCATACCGTCCCA)-3' | 1727 |
| pFastBacR | 5'-d (CAAATGTGGTATGGCTGATT)-3' | 1728 |
| pBAD Forward | 5'-d (ATGCCATAGCATTTTTATCC)-3' | 1729 |
| pBAD Reverse | 5'-d (GATTTAATCTGTATCAGG)-3' | 1730 |
| CMV-Forward | 5'-d (CGCAAATGGGCGGTAGGCGTG)-3' | 1731 |

Barcodes

As described herein, certain embodiments contemplate designing the template oligonucleotide sequences to contain short signature sequences that permit unambiguous identification of the template sequence, and hence of at least one primer responsible for amplifying that template, without having to sequence the entire amplification product. In the herein described template oligonucleotides of general formula (I), B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 or more contiguous nucleotides (including all integer values therebetween), wherein in each of the plurality of template oligonucleotide sequences B comprises a unique oligonucleotide sequence that uniquely identifies, as a paired combination, (i) the unique V oligonucleotide sequence of the template oligonucleotide and (ii) the unique J oligonucleotide sequence of the template oligonucleotide.

Thus, for instance, template oligonucleotides having barcode identifier sequences may permit relatively short amplification product sequence reads, such as barcode sequence reads of no more than 1000, 900, 800, 700, 600, 500, 400, 300, 200, 100, 90, 80, 70, 60, 55, 50, 45, 40, 35, 30, 25, 20, 19, 18, 17, 16, 15, 14, 13, 12, 11, 10, 9, 8, 7, 6, 5, 4 or fewer nucleotides, followed by matching this barcode sequence information to the associated V and J sequences that are incorporated into the template having the barcode as part of the template design. By this approach, a large number of amplification products can be simultaneously partially sequenced by high throughput parallel sequencing, to identify primers that are responsible for amplification bias in a complex primer set.

Exemplary barcodes may comprise a first barcode oligonucleotide of 5, 6, 7, 8, 9, 10, 11, 12, 13, 14, 15 or 16 nucleotides that uniquely identifies each V polynucleotide in the template and a second barcode oligonucleotide of 5, 6, 7, 8, 9, 10, 11, 12, 13, 14, 15 or 16 nucleotides that uniquely identifies each J polynucleotide in the template, to provide barcodes of, respectively, 10, 11, 12, 13, 14, 15, 16, 17, 18, 19, 20, 21, 22, 23, 24, 25, 26, 27, 28, 29, 30, 31 or 32 nucleotides in length, but these and related embodiments are not intended to be so limited. Barcode oligonucleotides may comprise oligonucleotide sequences of any length, so long as a minimum barcode length is obtained that precludes occurrence of a given barcode sequence in two or more template oligonucleotides having otherwise distinct sequences (e.g., V and J sequences).

Thus, the minimum barcode length, to avoid such redundancy amongst the barcodes that are used to uniquely identify different V-J sequence pairings, is X nucleotides, where $4^X$ is greater than the number of distinct template species that are to be differentiated on the basis of having non-identical sequences. For example, for the set of 871 template oligonucleotides set forth herein as SEQ ID NOS:1-871, the minimum barcode length would be five nucleotides, which would permit a theoretical total of 1024 (i.e., greater than 871) different possible pentanucleotide sequences. In practice, barcode oligonucleotide sequence read lengths may be limited only by the sequence read-length limits of the nucleotide sequencing instrument to be employed. For certain embodiments, different barcode oligonucleotides that will distinguish individual species of template oligonucleotides should have at least two nucleotide mismatches (e.g., a minimum hamming distance of 2) when aligned to maximize the number of nucleotides that match at particular positions in the barcode oligonucleotide sequences.

In preferred embodiments, for each distinct template oligonucleotide species having a unique sequence within the template composition of general formula (I), B 1, B2, B3, and B4 will be identical.

The skilled artisan will be familiar with the design, synthesis, and incorporation into a larger oligonucleotide or polynucleotide construct, of oligonucleotide barcode sequences of, for instance, at least 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 70, 80, 90, 100, 200, 300, 300, 500 or more contiguous nucleotides, including all integer values therebetween. For non-limiting examples of the design and implementation of oligonucleotide barcode sequence identification strategies, see, e.g., de Carcer et al., 2011 *Adv. Env. Microbiol.* 77:6310; Parameswaran et al., 2007 *Nucl. Ac. Res.* 35(19):330; Roh et al., 2010 *Trends Biotechnol.* 28:291.

Typically, barcodes are placed in templates at locations where they are not found naturally, i.e., barcodes comprise nucleotide sequences that are distinct from any naturally occurring oligonucleotide sequences that may be found in the vicinity of the sequences adjacent to which the barcodes are situated (e.g., V and/or J sequences). Such barcode sequences may be included, according to certain embodiments described herein, as elements B1, B2 and/or B3 of the presently disclosed template oligonucleotide of general formula (I). Accordingly, certain of the herein described template oligonucleotides of general formula (I) may also in certain embodiments comprise one, two or all three of barcodes B1, B2 and B3, while in certain other embodiments some or all of these barcodes may be absent. In certain embodiments all barcode sequences will have identical or similar GC content (e.g., differing in GC content by no more than 20%, or by no more than 19, 18, 17, 16, 15, 14, 13, 12, 11 or 10%).

In the template compositions according to certain herein disclosed embodiments the barcode-containing element B (e.g., B1, B2, B3, and/or B4) comprises the oligonucleotide sequence that uniquely identifies a single paired V–J combination. Optionally and in certain embodiments the barcode-containing element B may also include a random nucleotide, or a random polynucleotide sequence of at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 70, 80, 90, 100, 200, 300, 300, 500 or more contiguous nucleotides, situated upstream and/or downstream of the specific barcode sequence that uniquely identifies each specific paired V–J combination. When present both upstream and downstream of the specific barcode sequence, the random nucleotide or random polynucleotide sequence are independent of one another, that is, they may but need not comprise the same nucleotide or the same polynucleotide sequence.

Restriction Enzyme Sites

According to certain embodiments disclosed herein, the template oligonucleotide may comprise a restriction endonuclease (RE) recognition site that is situated between the V and J sequences and does not occur elsewhere in the template oligonucleotide sequence. The RE recognition site may optionally be adjacent to a barcode site that identifies the V region sequence. The RE site may be included for any of a number of purposes, including without limitation as a structural feature that may be exploited to destroy templates selectively by contacting them with the appropriate restriction enzyme. It may be desirable to degrade the present template oligonucleotides selectively by contacting them with a suitable RE, for example, to remove template oligonucleotides from other compositions into which they may have been deliberately or accidentally introduced. Alternatively, the RE site may be usefully exploited in the course of sequencing template oligonucleotides in the template composition, and/or as a positional sequence marker in a template oligonucleotide sequence regardless of whether or not it is cleaved with a restriction enzyme. An exemplary RE site is the oligonucleotide motif GTCGAC, which is recognized by the restriction enzyme Sal I. A large number of additional restriction enzymes and their respective RE recognition site sequences are known in the art and are available commercially (e.g., New England Biolabs, Beverly, Mass.). These include, for example, EcoRI (GAATTC) and SphI (GCATGC). Those familiar with the art will appreciate that any of a variety of such RE recognition sites may be incorporated into particular embodiments of the presently disclosed template oligonucleotides.

Sequencing

Sequencing may be performed using any of a variety of available high throughput single molecule sequencing machines and systems. Illustrative sequence systems include sequence-by-synthesis systems such as the Illumina Genome Analyzer and associated instruments (Illumina, Inc., San Diego, Calif.), Helicos Genetic Analysis System (Helicos BioSciences Corp., Cambridge, Mass.), Pacific Biosciences PacBio RS (Pacific Biosciences, Menlo Park, Calif.), or other systems having similar capabilities. Sequencing is achieved using a set of sequencing oligonucleotides that hybridize to a defined region within the amplified DNA molecules. The sequencing oligonucleotides are designed such that the V- and J-encoding gene segments can be uniquely identified by the sequences that are generated, based on the present disclosure and in view of known adaptive immune receptor gene sequences that appear in publicly available databases. See, e.g., U.S. application Ser. No. 13/217,126; U.S. application Ser. No. 12/794,507; PCT/US2011/026373; or PCT/US2011/049012. Exemplary TCRB J-region sequencing primers are set forth in Table 3:

TABLE 3

TCRBJ Sequencing Primers

| PRIMER | SEQUENCE | SEQ ID NO: |
|---|---|---|
| >Jseq1-1 | ACAACTGTGAGTCTGGTGCCTTGTCCAAAGAAA | 1696 |
| >Jseq1-2 | ACAACGGTTAACCTGGTCCCCGAACCGAAGGTG | 1697 |
| >Jseq1-3 | ACAACAGTGAGCCAACTTCCCTCTCCAAAATAT | 1698 |
| >Jseq1-4 | AAGACAGAGAGCTGGGTTCCACTGCCAAAAAAC | 1699 |
| >Jseq1-5 | AGGATGGAGAGTCGAGTCCCATCACCAAAATGC | 1700 |
| >Jseq1-6 | GTCACAGTGAGCCTGGTCCCGTTCCCAAAGTGG | 1701 |
| >Jseq2-1 | AGCACGGTGAGCCGTGTCCCTGGCCCGAAGAAC | 1702 |
| >Jseq2-2 | AGTACGGTCAGCCTAGAGCCTTCTCCAAAAAAC | 1703 |
| >Jseq2-3 | AGCACTGTCAGCCGGGTGCCTGGGCAAAATAC | 1704 |
| >Jseq2-4 | AGCACTGAGAGCCGGGTCCCGGCGCCGAAGTAC | 1705 |
| >Jseq2-5 | AGCACCAGGAGCCGCGTGCCTGGCCCGAAGTAC | 1706 |
| >Jseq2-6 | AGCACGGTCAGCCTGCTGCCGGCCCCGAAAGTC | 1707 |
| >Jseq2-7 | GTGACCGTGAGCCTGGTGCCCGGCCCGAAGTAC | 1708 |

The term "gene" means the segment of DNA involved in producing a polypeptide chain such as all or a portion of a TCR or Ig polypeptide (e.g., a CDR3-containing polypeptide); it includes regions preceding and following the coding region "leader and trailer" as well as intervening sequences (introns) between individual coding segments (exons), and may also include regulatory elements (e.g., promoters, enhancers, repressor binding sites and the like), and may also include recombination signal sequences (RSSs) as described herein.

The nucleic acids of the present embodiments, also referred to herein as polynucleotides, may be in the form of RNA or in the form of DNA, which DNA includes cDNA, genomic DNA, and synthetic DNA. The DNA may be double-stranded or single-stranded, and if single stranded may be the coding strand or non-coding (anti-sense) strand. A coding sequence which encodes a TCR or an immunoglobulin or a region thereof (e.g., a V region, a D segment, a J region, a C region, etc.) for use according to the present embodiments may be identical to the coding sequence known in the art for any given TCR or immunoglobulin gene regions or polypeptide domains (e.g., V-region domains, CDR3 domains, etc.), or may be a different coding sequence, which, as a result of the redundancy or degeneracy of the genetic code, encodes the same TCR or immunoglobulin region or polypeptide.

In certain embodiments, the amplified J-region encoding gene segments may each have a unique sequence-defined identifier tag of 2, 3, 4, 5, 6, 7, 8, 9, 10 or about 15, 20 or more nucleotides, situated at a defined position relative to a RSS site. For example, a four-base tag may be used, in the Jβ-region encoding segment of amplified TCRβ CDR3-encoding regions, at positions+11 through +14 downstream from the RSS site. However, these and related embodiments need not be so limited and also contemplate other relatively short nucleotide sequence-defined identifier tags that may be detected in J-region encoding gene segments and defined based on their positions relative to an RSS site. These may vary between different adaptive immune receptor encoding loci.

The recombination signal sequence (RSS) consists of two conserved sequences (heptamer, 5'-CACAGTG-3', and nonamer, 5'-ACAAAAACC-3'), separated by a spacer of either 12+/−1 bp ("12-signal") or 23+/−1 bp ("23-signal"). A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994; Akamatsu et. al. 1994; Hesse et. al. 1989). Mutations of other nucleotides have minimal or inconsistent effects. The spacer, although more variable, also has an impact on recombination, and single-nucleotide replacements have been shown to significantly impact recombination efficiency (Fanning et. al. 1996, Larijani et. al 1999; Nadel et. al. 1998). Criteria have been described for identifying RSS polynucleotide sequences having significantly different recombination efficiencies (Ramsden et. al 1994; Akamatsu et. al. 1994; Hesse et. al. 1989 and Cowell et. al. 1994). Accordingly, the sequencing oligonucleotides may hybridize adjacent to a four base tag within the amplified J-encoding gene segments at positions+11 through+14 downstream of the RSS site. For example, sequencing oligonucleotides for TCRB may be designed to anneal to a consensus nucleotide motif observed just downstream of this "tag", so that the first four bases of a sequence read will uniquely identify the J-encoding gene segment (see, e.g., WO/2012/027503).

The average length of the CDR3-encoding region, for the TCR, defined as the nucleotides encoding the TCR polypeptide between the second conserved cysteine of the V segment and the conserved phenylalanine of the J segment, is 35+/−3 nucleotides. Accordingly and in certain embodiments, PCR amplification using V-segment oligonucleotide primers with J-segment oligonucleotide primers that start from the J segment tag of a particular TCR or IgH J region (e.g., TCR Jβ, TCR Jγ or IgH JH as described herein) will nearly always capture the complete V-D-J junction in a 50 base pair read. The average length of the IgH CDR3 region, defined as the nucleotides between the conserved cysteine in the V segment and the conserved phenylalanine in the J segment, is less constrained than at the TCRβ locus, but will typically be between about 10 and about 70 nucleotides. Accordingly and in certain embodiments, PCR amplification using V-segment oligonucleotide primers with J-segment oligonucleotide primers that start from the IgH J segment tag will capture the complete V-D-J junction in a 100 base pair read.

PCR primers that anneal to and support polynucleotide extension on mismatched template sequences are referred to as promiscuous primers. In certain embodiments, the TCR and Ig J-segment reverse PCR primers may be designed to minimize overlap with the sequencing oligonucleotides, in order to minimize promiscuous priming in the context of multiplex PCR. In one embodiment, the TCR and Ig J-segment reverse primers may be anchored at the 3' end by annealing to the consensus splice site motif, with minimal overlap of the sequencing primers. Generally, the TCR and Ig V and J-segment primers may be selected to operate in PCR at consistent annealing temperatures using known sequence/primer design and analysis programs under default parameters.

For the sequencing reaction, the exemplary IGHJ sequencing primers extend three nucleotides across the conserved CAG sequences as described in WO/2012/027503.

Samples

The subject or biological source, from which a test biological sample may be obtained, may be a human or non-human animal, or a transgenic or cloned or tissue-engineered (including through the use of stem cells) organism. In certain preferred embodiments of the invention, the subject or biological source may be known to have, or may be suspected of having or being at risk for having, a circulating or solid tumor or other malignant condition, or an autoimmune disease, or an inflammatory condition, and in certain preferred embodiments of the invention the subject or biological source may be known to be free of a risk or presence of such disease.

Certain preferred embodiments contemplate a subject or biological source that is a human subject such as a patient that has been diagnosed as having or being at risk for developing or acquiring cancer according to art-accepted clinical diagnostic criteria, such as those of the U.S. National Cancer Institute (Bethesda, Md., USA) or as described in *DeVita, Hellman, and Rosenberg's Cancer: Principles and Practice of Oncology* (2008, Lippincott, Williams and Wilkins, Philadelphia/Ovid, N.Y.); Pizzo and Poplack, *Principles and Practice of Pediatric Oncology* (Fourth edition, 2001, Lippincott, Williams and Wilkins, Philadelphia/Ovid, N.Y.); and Vogelstein and Kinzler, *The Genetic Basis of Human Cancer* (Second edition, 2002, McGraw Hill Professional, New York); certain embodiments contemplate a human subject that is known to be free of a risk for having, developing or acquiring cancer by such criteria.

Certain other embodiments contemplate a non-human subject or biological source, for example a non-human primate such as a macaque, chimpanzee, gorilla, vervet, orangutan, baboon or other non-human primate, including such non-human subjects that may be known to the art as preclinical models, including preclinical models for solid tumors and/or other cancers. Certain other embodiments contemplate a non-human subject that is a mammal, for example, a mouse, rat, rabbit, pig, sheep, horse, bovine, goat, gerbil, hamster, guinea pig or other mammal; many such mammals may be subjects that are known to the art as preclinical models for certain diseases or disorders, including circulating or solid tumors and/or other cancers (e.g., Talmadge et al., 2007 *Am. J. Pathol.* 170:793; Kerbel, 2003 *Canc. Biol. Therap.* 2(4 Suppl 1):5134; Man et al., 2007 *Canc. Met. Rev.* 26:737; Cespedes et al., 2006 *Clin. Transl. Oncol.* 8:318). The range of embodiments is not intended to be so limited, however, such that there are also contemplated other embodiments in which the subject or biological source may be a non-mammalian vertebrate, for example, another higher vertebrate, or an avian, amphibian or reptilian species, or another subject or biological source.

Biological samples may be provided by obtaining a blood sample, biopsy specimen, tissue explant, organ culture, biological fluid or any other tissue or cell preparation from a subject or a biological source. Preferably the sample comprises DNA from lymphoid cells of the subject or biological source, which, by way of illustration and not limitation, may contain rearranged DNA at one or more TCR or BCR loci. In certain embodiments a test biological sample may be obtained from a solid tissue (e.g., a solid tumor), for example by surgical resection, needle biopsy or other means for obtaining a test biological sample that contains a mixture of cells.

According to certain embodiments, it may be desirable to isolate lymphoid cells (e.g., T cells and/or B cells) according to any of a large number of established methodologies, where isolated lymphoid cells are those that have been removed or separated from the tissue, environment or milieu in which they naturally occur. B cells and T cells can thus be obtained from a biological sample, such as from a variety of tissue and biological fluid samples including bone marrow, thymus, lymph glands, lymph nodes, peripheral tissues and blood, but peripheral blood is most easily accessed. Any peripheral tissue can be sampled for the presence of B and T cells and is therefore contemplated for use in the methods described herein. Tissues and biological fluids from which adaptive immune cells, may be obtained include, but are not limited to skin, epithelial tissues, colon, spleen, a mucosal secretion, oral mucosa, intestinal mucosa, vaginal mucosa or a vaginal secretion, cervical tissue, ganglia, saliva, cerebrospinal fluid (CSF), bone marrow, cord blood, serum, serosal fluid, plasma, lymph, urine, ascites fluid, pleural fluid, pericardial fluid, peritoneal fluid, abdominal fluid, culture medium, conditioned culture medium or lavage fluid. In certain embodiments, adaptive immune cells may be isolated from an apheresis sample. Peripheral blood samples may be obtained by phlebotomy from subjects. Peripheral blood mononuclear cells (PBMC) are isolated by techniques known to those of skill in the art, e.g., by Ficoll-Hypaque® density gradient separation. In certain embodiments, whole PBMCs are used for analysis.

For nucleic acid extraction, total genomic DNA may be extracted from cells using methods known in the art and/or commercially available kits, e.g., by using the QIAamp® DNA blood Mini Kit (QIAGEN®). The approximate mass of a single haploid genome is 3 pg. Preferably, at least 100,000 to 200,000 cells are used for analysis, i.e., about 0.6 to 1.2 µg DNA from diploid T or B cells. Using PBMCs as a source, the number of T cells can be estimated to be about 30% of total cells. The number of B cells can also be estimated to be about 30% of total cells in a PBMC preparation.

The Ig and TCR gene loci contain many different variable (V), diversity (D), and joining (J) gene segments, which are subjected to rearrangement processes during early lymphoid differentiation. Ig and TCR V, D and J gene segment sequences are known in the art and are available in public databases such as GENBANK. The V-D-J rearrangements are mediated via a recombinase enzyme complex in which the RAG1 and RAG2 proteins play a key role by recognizing and cutting the DNA at the recombination signal sequences (RSS), which are located downstream of the V gene segments, at both sides of the D gene segments, and upstream of the J gene segments. Inappropriate RSS reduce or even completely prevent rearrangement. The recombination signal sequence (RSS) includes two consensus sequences (heptamer, 5'-CACAGTG-3', and nonamer, 5'-ACAAAAACC-3'), separated by a spacer of either 12+/−1 bp ("12-signal") or 23+/−1 bp ("23-signal"). At the 3' end of the V segment and D segment the RSS sequence is heptamer (CACAGTG)-spacer-nonamer (ACAAAAACC). At the 5' end of the J segment and D segment the RSS sequence is nonamer (GGTTTTTGT)-spacer-heptamer (CACTGTG), with substantial sequence variation in the heptamer and nonamer sequence of each specific gene segment.

A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994 *Nucl. Ac. Res.* 22:1785; Akamatsu et. al. 1994 *J. Immunol.* 153:4520; Hesse et. al. 1989 *Genes Dev.* 3:1053). Mutations of other nucleotides have minimal or inconsistent effects. The spacer, although more variable, also has an impact on recombination, and single-nucleotide replacements have been shown to significantly impact recombination efficiency (Fanning et. al. 1996 *Cell. Immunol. Immumnopath.* 79:1, Larijani et. al 1999 *Nucl. Ac. Res.* 27:2304; Nadel et. al. 1998 *J. Immunol.* 161:6068; Nadel et al., 1998 J. Exp. Med. 187:1495). Criteria have been described for identifying RSS polynucleotide sequences having significantly different recombination efficiencies (Ramsden et. al 1994 *Nucl. Ac. Res.* 22:1785; Akamatsu et. al. 1994 *J. Immunol.* 153:4520; Hesse et. al. 1989 *Genes Dev.* 3:1053, and Lee et al., 2003 *PLoS* 1(1):E1).

The rearrangement process at the Ig heavy chain (IgH), TCR beta (TCRB), and TCR delta (TCRD) genes generally starts with a D to J rearrangement followed by a V to D-J rearrangement, while direct V to J rearrangements occur at Ig kappa (IgK), Ig lambda (IgL), TCR alpha (TCRA), and TCR gamma (TCRG) genes. The sequences between rearranging gene segments are generally deleted in the form of a circular excision product, also called TCR excision circle (TREC) or B cell receptor excision circle (BREC).

The many different combinations of V, D, and J gene segments represent the so-called combinatorial repertoire, which is estimated to be $\sim 2 \times 10^6$ for Ig molecules, $\sim 3 \times 10^6$ for TCRαβ and $\sim 5 \times 10^3$ for TCRγδ molecules. At the junction sites of the V, D, and J gene segments, deletion and random insertion of nucleotides occurs during the rearrangement process, resulting in highly diverse junctional regions, which significantly contribute to the total repertoire of Ig and TCR molecules, estimated to be $>10^{12}$ possible amino acid sequences.

Mature B-lymphocytes further extend their Ig repertoire upon antigen recognition in germinal centers via somatic hypermutation, a process leading to affinity maturation of the Ig molecules. The somatic hypermutation process focuses on the V- (D-) J exon of IgH and Ig light chain genes and primarily generates single nucleotide mutations but sometimes also insertions or deletions of nucleotides. Somatically-mutated Ig genes are also typically found in mature B-cell malignancies.

In certain embodiments described herein, V-segment and J-segment primers may be employed in a PCR reaction to amplify rearranged TCR or BCR CDR3-encoding DNA regions in a test biological sample, wherein each functional TCR or Ig V-encoding gene segment comprises a V gene recombination signal sequence (RSS) and each functional TCR or Ig J-encoding gene segment comprises a J gene RSS. In these and related embodiments, each amplified rearranged DNA molecule may comprise (i) at least about 10, 20, 30, 40, 50, 60, 70, 80, 90, 100, 200, 300, 400, 500, 600, 700, 800, 900, 1000 (including all integer values therebetween) or more contiguous nucleotides of a sense strand of the TCR or Ig V-encoding gene segment, with the at least about 10, 20, 30, 40, 50, 60, 70, 80, 90, 100, 200, 300, 400, 500, 600, 700, 800, 900, 1000 or more contiguous nucleotides being situated 5' to the V gene RSS and/or each amplified rearranged DNA molecule may comprise (ii) at least about 10, 20, 30, 40, 50, 60, 70, 80, 90, 100, 200, 300, 400, 500 (including all integer values therebetween) or more contiguous nucleotides of a sense strand of the TCR or Ig J-encoding gene segment, with the at least about 10, 20, 30, 40, 50, 60, 70, 80, 90, 100, 200, 300, 400, 500 or more contiguous nucleotides being situated 3' to the J gene RSS.

Amplification Factor Determination

In addition to the use of the presently disclosed template compositions for standardizing amplification efficiency of oligonucleotide amplification primer sets as described herein, certain other embodiments contemplate use of the template composition to determine amplification factors for estimating the number of rearranged adaptive immune receptor encoding sequences in a sample. These and related embodiments may find use to quantify the number of adaptive immune receptor encoding sequences in a DNA sample that has been obtained from lymphoid cells, including lymphoid cells that are present in a mixture of cells that comprises cells in which DNA encoding an adaptive immune receptor has undergone DNA rearrangement, but where the sample also contains DNA from cells in which no such rearrangement has taken place (e.g., non-lymphoid cells, immature cells, mesenchymal cells, cancer cells, etc.).

The total number of different members of a given class of adaptive immune receptors (e.g., TCRs or IGs) in a subject may be estimated by multiplexed PCR using a comprehensive V–J amplification primer set followed by quantitative sequencing of amplification products. Multiplexed amplification and high throughput sequencing of rearranged TCR and BCR (IG) encoding DNA sequences are described, for example, in Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09.001; Sherwood et al. 2011 *Sci. Translat. Med.* 3:90ra61; U.S. application Ser. No. 13/217,126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118.

This methodology typically involves sampling DNA from a subpopulation of lymphoid cells, such as lymphoid cells that are present in a blood sample, which is known also to contain nucleated cells that lack rearranged TCR or IG encoding DNA. The present compositions and methods may permit improved accuracy and precision in the determination of the number of rearranged TCR and IG encoding DNA molecules in such a sample. As described herein, for instance, by spiking the DNA sample with the present template composition, an internal amplification template standard is provided for assessing the relative efficiencies across the range of oligonucleotide primers that are present in the multiplexed amplification primer set. By so assessing the amplification products of the present artificial template composition, which is added to the amplification reaction in known amounts, an amplification factor (e.g., a multiplicative, normalizing, scaling or geometric factor, etc.) can be determined for the oligonucleotide amplification primer set and can then be used to calculate the number of natural DNA templates in the sample.

As another example, these and related embodiments permit quantification of Minimal Residual Disease (MRD) in lymphoma or leukemia, by quantitative detection of rearranged TCR or IG encoding DNA in samples obtained from mixed preparations of lymphoid and non-lymphoid cells, including persistent lymphoma or leukemia cells. Prior methods determine MRD as the number of malignant cells that are detectable as a proportion of the total number of cells in a sample. In contrast, the present methods permit estimation of the total number of cells in a sample that have rearranged TCR or IG encoding DNA, so that malignant cells (e.g., those having a particular TCR or IG rearrangement, such as a clonotype) can be quantified as a proportion of such rearranged cells instead of as a proportion of all cells. By way of non-limiting theory, it is believed that because the representation of all rearranged cells in a clinical sample from a subject having or suspected of having MRD is typically very low, the present methods will dramatically improve the sensitivity with which MRD can be detected, including improving such sensitivity by increasing the signal-to-noise ratio.

Accordingly certain embodiments thus provide a method for quantifying rearranged DNA molecules encoding one or a plurality of adaptive immune receptors in a biological sample that comprises DNA from lymphoid cells of a subject, each adaptive immune receptor comprising a variable region and a joining region. Briefly, the method comprises the steps of:

(A) in a multiplexed amplification reaction using the herein described oligonucleotide amplification primer set that is capable of amplifying substantially all V–J encoding combinations for a given adaptive immune receptor, amplifying DNA from the sample to which has been added a known amount of the herein described template composition for standardizing amplification efficiency, to obtain amplification products;

(B) quantitatively sequencing the amplification products of (A) to quantify (i) template amplification products, which are amplification products of the herein described template composition and will be identifiable because they contain at least one barcode oligonucleotide sequence, and (ii) amplification products of rearranged adaptive immune receptor encoding DNA sequences in the sample, which will be identifiable because they contain specific V and J sequences but lack an oligonucleotide barcode sequence;

(C) calculating an amplification factor based on quantitative information obtained in step (B); and (D) using the amplification factor of (C) to determine, by calculation, the number of unique adaptive immune receptor encoding DNA molecules in the sample.

Without wishing to be bound by theory, according to these and related methods, the number of rearranged TCR or IG encoding DNA molecules that are sampled in a multiplexed amplification reaction is measured. To do so, a sequence coverage value, e.g., the number of output sequence reads that are determined for each input (template) molecule, is determined and averaged across the entire number of different template oligonucleotides that are present, to obtain an average sequence coverage value. By dividing (i) the number of reads that are obtained for a given sequence by (ii) the average sequence coverage value, the number of rearranged molecules that are present as templates at the start of the amplification reaction can be calculated.

Thus, for example, to calculate the sequence coverage value, a known quantity of a set of synthetic molecules of the presently disclosed template composition is added to each PCR amplification, the synthetic templates having the basic structure of formula (I) 5'U-B1-V-B2-R-(B3)-J-B4-U 3' where each V is a 300 base pair segment having a sequence that matches a TCR or IG V gene sequence and J is a 100 base pair segment having a sequence that matches a TCR or IG J gene. B2 is a unique barcode oligonucleotide sequence that uniquely identifies each VJ pair and that also differentiates amplification products of the synthetic DNA templates (which will contain the barcode sequence) from amplification products of naturally occurring biologic template DNA molecules that are contributed by the lymphoid DNA sample (which will lack the barcode sequence). In this example, B3 of formula (I) is nothing. After PCR amplification and sequencing, the numbers of each sequenced synthetic molecule (i.e., amplification products containing the barcode sequence) are counted. The sequence coverage of the synthetic molecules is then calculated based on the known number of starting synthetic template molecules used to spike the amplification reaction.

Figure 8:
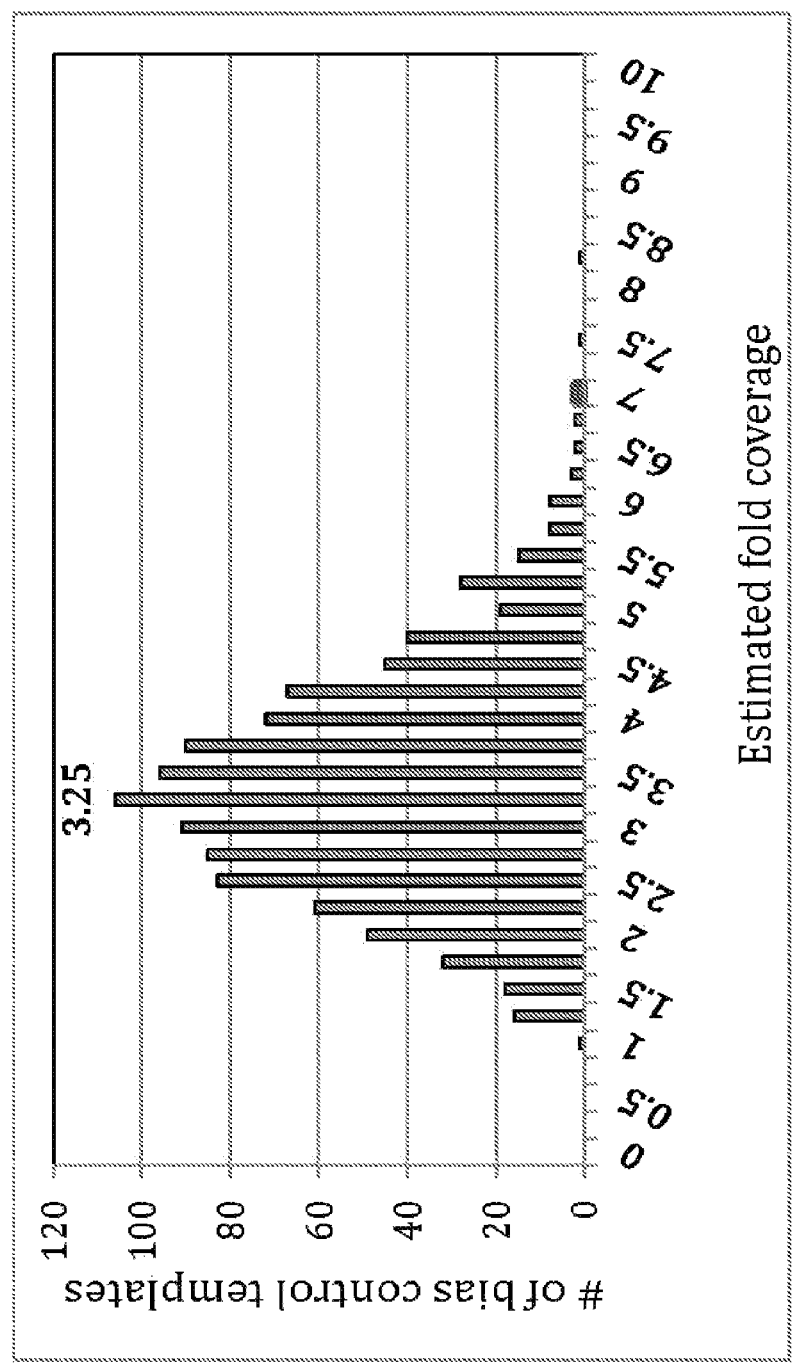
FIG. 8 shows the results of calculating an amplification factor for each VJ pair in a template composition that was added to a multiplexed PCR amplification of IGH sequences, and then averaging the amplification factor across all synthetic templates to estimate fold sequence coverage across all synthetic template molecules.
Figure 9:
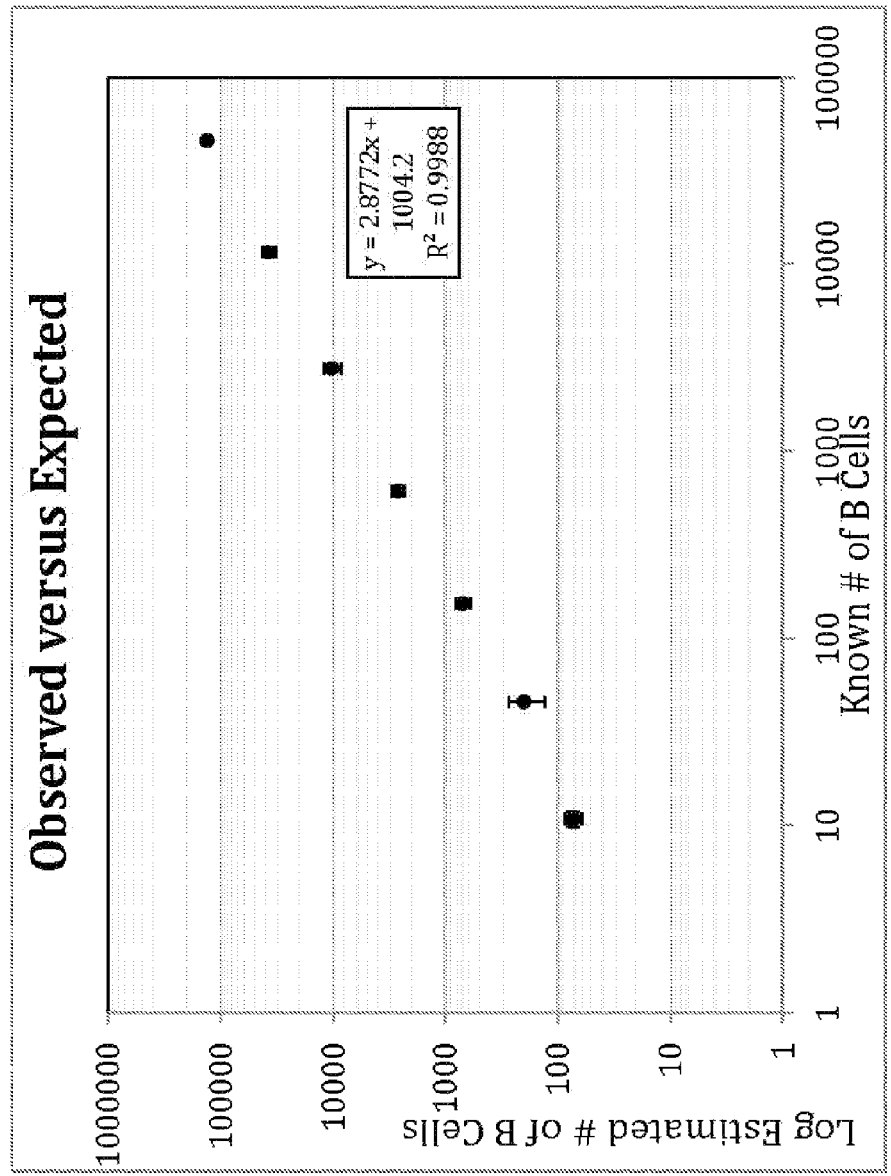
FIG. 9 shows a plot of the numbers of B cells that were estimated using a synthetic template composition and amplification factor as described herein, versus the known numbers of B cells used as a source of natural DNA templates.

For example, a pool of 5000 synthetic, barcode-containing template molecules comprising 4-5 copies each of 1100 unique synthetic template oligonucleotide sequences (representing every possible VJ pair) may be added to the amplification reaction. If the amplification products include 50,000 sequences that match the synthetic template molecules, a sequence coverage value of 10× has been obtained and the amplification factor is 10. To estimate the number of natural VDJ-rearranged template molecules in the DNA obtained from the sample, the number of amplification products of the natural templates (i.e., amplification products that lack any barcode sequence) is then divided by the amplification factor. For added accuracy, because in this example the 5000 synthetic molecules are a complex pool of 1100 molecules representing every VJ pair, the amplification factor for every VJ pair can be individually calculated. The amplification factor can then be averaged across all of the synthetic molecules (FIG. 8). The accuracy and robustness of the method is shown in FIG. 9 and details are described below in Example 5.

In an alternative embodiment, identical to what is described above and below in this section, except differing in the use of a subset of the total pool of synthetic template molecules is used in a manner resulting in the addition to a sample of not more than 1 copy of a subset of distinct template molecules to the sample. Application of Poisson statistical methods well known to the ordinarily skilled artisan are used to determine the amount of template to add based upon the known properties of the pool (e.g., the total number of distinct sequences and the concentration of template molecules). For example, 200-500 template molecules are added to the amplification reaction, such that there is on average not more than one copy each of a subset of template molecules present in the pool.

Accordingly, in these embodiments the method comprises: (A) amplifying DNA in a multiplex polymerase chain reaction (PCR) that comprises: (1) DNA from the biological sample that comprises lymphoid cells of the subject, (2) the template composition of claim 1 in which a known number of each of the plurality of template oligonucleotides having a unique oligonucleotide sequence is present, (3) an oligonucleotide amplification primer set that is capable of amplifying rearranged DNA encoding one or a plurality of adaptive immune receptors in the DNA from the biological sample, the primer set comprising: (a) in substantially equimolar amounts, a plurality of V-segment oligonucleotide primers that are each independently capable of specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one functional adaptive immune receptor V region-encoding gene segment and wherein the plurality of V-segment primers specifically hybridize to substantially all functional adaptive immune receptor V region-encoding gene segments that are present in the template composition, and (b) in substantially equimolar amounts, a plurality of 0.1-segment oligonucleotide primers that are each independently capable of specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one functional adaptive immune receptor J region-encoding gene segment and wherein the plurality of J-segment primers specifically hybridize to substantially all functional adaptive immune receptor J region-encoding gene segments that are present in the template composition, wherein the V-segment and J-segment oligonucleotide primers are capable of promoting amplification in said multiplex polymerase chain reaction (PCR) of (i) substantially all template oligonucleotides in the template composition to produce a multiplicity of amplified template DNA molecules, said multiplicity of amplified template DNA molecules being sufficient to quantify diversity of the template oligonucleotides in the template composition, and (ii) substantially all rearranged DNA molecules encoding adaptive immune receptors in the biological sample to produce a multiplicity of amplified rearranged DNA molecules, said multiplicity of amplified rearranged DNA molecules being sufficient to quantify diversity of the rearranged DNA molecules in the DNA from the biological sample, and wherein each amplified DNA molecule in the multiplicity of amplified template DNA molecules and in the multiplicity of amplified rearranged DNA molecules is less than 1000, 900, 800, 700, 600, 500, 400, 300, 200, 100, 90, 80 or 70 nucleotides in length;

(B) quantitatively sequencing all or a sufficient portion of each of said amplified template DNA molecules and each of said amplified rearranged DNA molecules to quantify (i) a template product number of amplified template DNA molecules which contain at least one oligonucleotide barcode sequence, and (ii) a rearranged product number of amplified rearranged DNA molecules which lack an oligonucleotide barcode sequence;

(C) calculating an amplification factor by dividing the template product number of (B)(i) by the known number of each of the plurality of template oligonucleotides having a unique oligonucleotide sequence of (A)(2); and (D) dividing the rearranged product number of (B)(ii) by the amplification factor calculated in (C) to quantify unique adaptive immune receptor encoding DNA molecules in the sample.

The contemplated embodiments are not intended to be limited to the above described method, such that from the present disclosure the skilled person will appreciate variations that may be employed. An alternative approach, for example, may not use the herein described synthetic template composition as a spiked-in control template in multiplexed PCR amplification of a DNA sample that contains rearranged lymphoid cell TCR and/or IG encoding DNA as well as non-rearranged DNA. Instead, according to one such alternative, to the amplification reaction using V and J amplification primers may be added a known set of oligonucleotide amplification primers that amplify a distinct, highly conserved genomic sequence region. These genomic control primers may amplify every genome that is present in the DNA sample regardless of whether or not it contains rearranged TCR and/or IG encoding sequences, whereas the V and J primers may amplify products only from genomes with a rearranged VDJ region. The ratio between these two classes of amplification product molecules permits estimation of the total number of B cell genomes in the sample.

The practice of certain embodiments of the present invention will employ, unless indicated specifically to the contrary, conventional methods in microbiology, molecular biology, biochemistry, molecular genetics, cell biology, virology and immunology techniques that are within the skill of the art, and reference to several of which is made below for the purpose of illustration. Such techniques are explained fully in the literature. See, e.g., Sambrook, et al., *Molecular Cloning: A Laboratory Manual* (3$^{rd}$ Edition, 2001); Sambrook, et al., *Molecular Cloning: A Laboratory Manual* (2$^{nd}$ Edition, 1989); Maniatis et al., *Molecular Cloning: A Laboratory Manual* (1982); Ausubel et al., *Current Protocols in Molecular Biology* (John Wiley and Sons, updated July 2008); *Short Protocols in Molecular Biology: A Compendium of Methods from Current Protocols in Molecular Biology*, Greene Pub. Associates and Wiley-Interscience; Glover, DNA Cloning: A Practical Approach, vol. I & II (IRL Press, Oxford Univ. Press USA, 1985); *Current Protocols in Immunology* (Edited by: John E. Coligan, Ada M. Kruisbeek, David H. Margulies, Ethan M. Shevach, Warren Strober 2001 John Wiley & Sons, NY, NY); *Real-Time PCR: Current Technology and Applications*, Edited by Julie Logan, Kirstin Edwards and Nick Saunders, 2009, Caister Academic Press, Norfolk, UK; Anand, *Techniques for the Analysis of Complex Genomes*, (Academic Press, New York, 1992); Guthrie and Fink, *Guide to Yeast Genetics and Molecular Biology* (Academic Press, New York, 1991); *Oligonucleotide Synthesis* (N. Gait, Ed., 1984); *Nucleic Acid Hybridization* (B. Hames & S. Higgins, Eds., 1985); *Transcription and Translation* (B. Hames & S. Higgins, Eds., 1984); *Animal Cell Culture* (R. Freshney, Ed., 1986); Perbal, *A Practical Guide to Molecular Cloning* (1984); *Next-Generation Genome Sequencing* (Janitz, 2008 Wiley-VCH); *PCR Protocols (Methods in Molecular Biology)* (Park, Ed., 3$^{rd}$ Edition, 2010 Humana Press); *Immobilized Cells And Enzymes* (IRL Press, 1986); the treatise, *Methods In Enzymology* (Academic Press, Inc., N.Y.); *Gene Transfer Vectors For Mammalian Cells* (J. H. Miller and M. P. Calos eds., 1987, Cold Spring Harbor Laboratory); Harlow and Lane, *Antibodies*, (Cold Spring Harbor Laboratory Press, Cold Spring Harbor, N.Y., 1998); *Immunochemical Methods In Cell And Molecular Biology* (Mayer and Walker, eds., Academic Press, London, 1987); *Handbook Of Experimental Immunology*, Volumes I-IV (D. M. Weir and CC Blackwell, eds., 1986); Riott, *Essential Immunology*, 6th Edition, (Blackwell Scientific Publications, Oxford, 1988); *Embryonic Stein Cells: Methods and Protocols (Methods in Molecular Biology)* (Kurstad Turksen, Ed., 2002); *Embryonic Stem Cell Protocols: Volume I: Isolation and Characterization* (Methods in Molecular Biology) (Kurstad Turksen, Ed., 2006); *Embryonic Stem Cell Protocols: Volume II: Differentiation Models* (Methods in Molecular Biology) (Kurstad Turksen, Ed., 2006); *Human Embryonic Stem Cell Protocols* (Methods in Molecular Biology) (Kursad Turksen Ed., 2006); *Mesenchymal Stem Cells: Methods and Protocols* (Methods in Molecular Biology) (Darwin J. Prockop, Donald G. Phinney, and Bruce A. Bunnell Eds., 2008); *Hematopoietic Stem Cell Protocols* (Methods in Molecular Medicine) (Christopher A. Klug, and Craig T. Jordan Eds., 2001); *Hematopoietic Stem Cell Protocols* (Methods in Molecular Biology) (Kevin D. Bunting Ed., 2008) *Neural Stem Cells: Methods and Protocols* (Methods in Molecular Biology) (Leslie P. Weiner Ed., 2008).

Unless specific definitions are provided, the nomenclature utilized in connection with, and the laboratory procedures and techniques of, molecular biology, analytical chemistry, synthetic organic chemistry, and medicinal and pharmaceutical chemistry described herein are those well known and commonly used in the art. Standard techniques may be used for recombinant technology, molecular biological, microbiological, chemical syntheses, chemical analyses, pharmaceutical preparation, formulation, and delivery, and treatment of patients.

Unless the context requires otherwise, throughout the present specification and claims, the word "comprise" and variations thereof, such as, "comprises" and "comprising" are to be construed in an open, inclusive sense, that is, as "including, but not limited to". By "consisting of" is meant including, and typically limited to, whatever follows the phrase "consisting of." By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that no other elements are required and may or may not be present depending upon whether or not they affect the activity or action of the listed elements.

In this specification and the appended claims, the singular forms "a," "an" and "the" include plural references unless the content clearly dictates otherwise. As used herein, in particular embodiments, the terms "about" or "approximately" when preceding a numerical value indicates the value plus or minus a range of 5%, 6%, 7%, 8% or 9%. In other embodiments, the terms "about" or "approximately" when preceding a numerical value indicates the value plus or minus a range of 10%, 11%, 12%, 13% or 14%. In yet other embodiments, the terms "about" or "approximately" when preceding a numerical value indicates the value plus or minus a range of 15%, 16%, 17%, 18%, 19% or 20%.

Reference throughout this specification to "one embodiment" or "an embodiment" or "an aspect" means that a particular feature, structure or characteristic described in connection with the embodiment is included in at least one embodiment of the present invention. Thus, the appearances of the phrases "in one embodiment" or "in an embodiment" in various places throughout this specification are not necessarily all referring to the same embodiment. Furthermore, the particular features, structures, or characteristics may be combined in any suitable manner in one or more embodiments.

EXAMPLES

Example 1

Design of Template Oligonucleotides for Calibrating Amplification Primer Bias Control In this and the following Examples, standard molecular biology and biochemistry materials and methodologies were employed, including techniques described in, e.g., Sambrook, et al., *Molecular Cloning: A Laboratory Manual* (3$^{rd}$ Edition, 2001); Sambrook, et al., *Molecular Cloning: A Laboratory Manual* (2$^{nd}$ Edition, 1989); Maniatis et al., *Molecular Cloning: A Laboratory Manual* (1982); Ausubel et al., *Current Protocols in Molecular Biology* (John Wiley and Sons, updated July 2008); *Short Protocols in Molecular Biology: A Compendium of Methods from Current Protocols in Molecular Biology*, Greene Pub. Associates and Wiley-Interscience; Glover, *DNA Cloning: A Practical Approach*, vol. I & II (IRL Press, Oxford Univ. Press USA, 1985); Anand, *Techniques for the Analysis of Complex Genomes*, (Academic Press, New York, 1992); *Oligonucleotide Synthesis* (N. Gait, Ed., 1984); *Nucleic Acid Hybridization* (B. Hames & S. Higgins, Eds., 1985); *Transcription and Translation* (B. Hames & S. Higgins, Eds., 1984); Perbal, *A Practical Guide to Molecular Cloning* (1984); *Next-Generation Genome Sequencing* (Janitz, 2008 Wiley-VCH); *PCR Protocols (Methods in Molecular Biology)* (Park, Ed., 3rd Edition, 2010 Humana Press).

A set of double-stranded DNA (dsDNA) template oligonucleotides was designed as a calibration standard for use as a control template that simulated all possible V/J combinations at a specified adaptive immune receptor (TCR or BCR) locus. For each human TCR and BCR locus, a list was compiled of the known genomic V segment sequences 5' of the RSS, and a list of the known genomic J segments 3' of the RSS. The coding strand sequences of the dsDNA template are presented here for ease of interpretation, according to the convention by which the 5'-to-3' orientation is read left-to-right.

A schematic representation of the general structure of the template oligonucleotides is shown in FIG. 1. For use in cross-validation of each unique template oligonucleotide's identity in multiple contexts, a different 16 bp barcode oligonucleotide (B) was incorporated into each template that uniquely identified the V segment polynucleotide of the template with the first 8 bp of the barcode, and the J segment with the second 8 bp of the barcode. Copies of this barcode were incorporated thrice: (B3) between the external adapter (U2) and the J segment sequence (J) so that a short single-end read with standard Illumina or Ion primers can reveal the identity of the unique combination of V and J sequences in each template oligonucleotide, (B2) between the V and J segments so that a standard sequencing strategy (e.g., Illumina GA-2 or HiSeq™ or MiSEQ®) will capture the unique combination of V and J sequences in each template oligonucleotide, and (B3) between the V segment and the other external adapter (U1), so that a short paired-end read can confirm the identity of the unique combination of V and J sequences in each template oligonucleotide if so desired.

As shown in FIG. 1, the template oligonucleotide sequences started with an adapter sequence (U1) that was capable of incorporating sequencing platform-specific short oligonucleotide sequences at the ends of the molecule. In this example the Illumina Nextera™ adaptors were used, but it should be noted that essentially any pair of robust PCR primers would work equally well. As an exemplary adapter, the oligonucleotide sequence GCCTTGCCAGCCCGCTCAG [SEQ ID NO:1746] was attached at the V segment end of U1 (FIG. 1), in order to maintain compatibility with the Nextera™ Illumina Adaptor (Illumina, Inc., San Diego, Calif.) (CAAGCAGAAGACGGCATACGAGATCGGTCT GCCTTGCCAGCCCGCTCAG) [SEQ ID NO:1747] to add on the standard Illumina oligonucleotide, which was compatible with either single or paired end Illumina sequencing flowcells.

Immediately downstream from (3' to) U1 was the first copy (B1) of the barcode oligonucleotide ACACACGTGA-CACTCT [SEQ ID NO:1748]. Next, a fixed length of V segment sequence was incorporated into the template oligonucleotide, with all templates in the template set ending a given number of bases before the natural RSS, in order to mimic a natural TCR or BCR gene rearrangement having a fixed number of bases deleted at the V segment. In this example zero bases were initially deleted before the RSS. To maximize the recognizability of these sequences, all V segment polynucleotide sequences were then trimmed to remove partial codons adjacent to the RSS, so that the residual V segment sequences were in frame with the start codon. Diverse V segment sequences were those shown in the exemplary template oligonucleotide sets presented in the Sequence Listing (e.g., a set of TCRB V segments within the formula (I) sequences of the TCRB template oligonucleotide set in SEQ ID NOS:1-871; a distinct set of TCRB V segments within the formula (I) sequences of the TCRB template oligonucleotide set in SEQ ID NOS:872-1560; a set of TCRG V segments within the formula (I) sequences of the TCRG template oligonucleotide set in SEQ ID NOS:1561-1630); a single exemplary V polynucleotide was as follows:
TCTTATTTTCATAGGCTCCATG-GATACTGGAATTACCCAGACACCAAAA TACCTGGT-CACAGCAATGGGGAGTAAAAGGACAAT-GAAACGTGAGCATCTGGGA CATGATTCTATGTATTGGTACAGACA-GAAAGCTAAGAAATCCCTGGAGTTCATGT TTTAC-TACAACTGTAAGGAATTCATTGAAAA-CAAGACTGTGCCAAATCACTTCAC ACCTGAATGCCCTGACAGCTCTCGCT-TATACCTTCATGTGGTCGCACTGCAGCAA GAA-GACTCAGCTGCGTATCTCTGCACCAGCAG [SEQ ID NO:1749].

The stop codon TGA was incorporated in-frame at the 3' end of the V polynucleotide sequence in each template oligonucleotide, to ensure that the template oligonucleotide sequences would not be considered relevant in the event they contaminated a biological sample. Downstream from the stop codon, between the V segment and J segment where the NDN would normally be, the second copy of the V/J identifier barcode sequence B2 (SEQ ID NO:1748) was inserted. Next the Sal1 restriction enzyme recognition site (R) sequence GTCGAC was incorporated; this sequence was selected on the basis of being a sequence that was not naturally present in any of the TCRB V or J segment genomic sequences, conferring the ability to specifically destroy the synthetic template if desired, or for use as an informatic marker to identify the synthetic sequences. The B3 site, in this version of the template is empty.

The J polynucleotide (J) was incorporated as a fixed length of sequence from a J gene segment, measured from a fixed number of bases after the natural RSS to mimic a natural rearrangement, and in the present example extending into the J-C intron. In this example zero bases were deleted bases from the J segment, but in other template oligonucleotide designs a deletion of 5 bp was used to make room for the VJ barcode (B2) at the V–J junction while maintaining an overall J segment length in the natural range. An exemplary J polynucleotide was
ACTGAAGCTTTCTTTGGACAAGGCACCA-GACTCACAGTTGTAGGTAAG ACATTTTTCAGGT-TCTTTTGCAGATCCGTCACAGG-GAAAAGTGGGTCCACAG [SEQ ID NO:1750].

Downstream from the J segment polynucleotide was the third copy (B4) of the V/J barcode identifier oligonucleotide (SEQ ID NO:1748). The exemplary template oligonucleotide sequence the sequence ended with a second adapter sequence (U2) that was capable of incorporating platform-specific sequences at the ends of the molecule. As noted above, a Nextera™-compatible adaptor (CTGATGGCGCGAGG-GAGGC) [SEQ ID NO:1751] was used on the J segment end of U2, for use with the Nextera™ Illumina Adaptor (AAT-GATACGGCGACCACCGAGATCTACACGC-CTCCCTCGCGCCATCAG) [SEQ ID NO:1752] to permit adding on the standard Illumina sequencing oligonucleotide, which is compatible with either single or paired end flowcells.

Exemplary TCRB and TCRG template oligonucleotide sets according to the present disclosure were prepared and had the nucleotide sequences set forth in SEQ ID NOS:1-1630. The sets of template oligonucleotides having sequences set forth in SEQ ID NOS:1-871 and 1561-1630 were custom synthesized, based on the sequence design information disclosed herein, by Integrated DNA Technologies, Inc. (Coralville, Iowa) using gBlocks™ Gene Fragments chemistry. The set of template oligonucleotides having sequences set forth in SEQ TD NOS:872-1560 was generated by a PCR tiling approach described in Example 2.

TCRB Template Oligonucleotides (SEQ ID NOS:1-871). A set of 871 template oligonucleotides of general formula (I) (in which B3 is nothing) was designed using human TCRB V and J polynucleotide sequences:

$$5'\text{-}U1\text{-}B1\text{-}V\text{-}B2\text{-}R\text{-}(B3)\text{-}J\text{-}B4\text{-}U2\text{-}3' \qquad (I).$$

Each template oligonucleotide consisted of a 495 base pair DNA molecule. Sense strand sequences are presented as SEQ TD NOS:1-871.

A schematic diagram depicting the design of this template set is shown in FIG. 1. By convention, the diagram depicts the oligonucleotide design in the 5'-to 3' (left-to-right) direction. "V segment" represents an adaptive immune receptor variable (V) region encoding gene sequence, or the complement thereof "J segment" represents an adaptive immune receptor joining (J) region encoding gene sequence, or the complement thereof. U1 and U2 represent, respectively, first and second universal adaptor oligonucleotide sequences, which may optionally further comprise, respectively, first and second sequencing platform-specific oligonucleotide sequences linked to and positioned 5' to the first and second universal adaptor oligonucleotide sequences. B1, B2 and B4 represent oligonucleotide barcode sequences that each comprise an oligonucleotide barcode sequence comprising a unique oligonucleotide sequence that uniquely identifies, as a paired combination, (i) a unique V segment sequence, and (ii) a unique J segment sequence; in this Example, B3 was nothing.

S represents an optional stop codon that may be in-frame or out of frame at the 3' end of V. R represents an optional restriction enzyme recognition site. In SEQ ID NOS:1-871 the U1 and U2 adapters included the 19-mers as described above (SEQ ID NOS:1746 and 1751, respectively) and all (V+J)-identifying barcode (B) sequences (B1, B2, B4) were 16 nucleotides in length; the stop codon TGA and the Sal1 restriction enzyme recognition site (GTCGAC) were included.

TCRB Template Oligonucleotides (SEQ ID NOS:872-1560). A second set of 689 template oligonucleotides was designed in which, according to general formula (I), V and J comprised, respectively, human TCRB V and J polynucleotide sequences, U1 and U2 independently comprised distinct restriction enzyme recognition sites (R1 and R3), and B1, B3, and B4 were independently nothing, to arrive at general formula (II):

$$R1\text{-}V\text{-}B2\text{-}R2\text{-}J\text{-}R3 \qquad (II)$$

wherein B2 was an 8-nucleotide barcode identifier (e.g., a barcode sequence as set forth in Table 7); R1, R2 and R3 were, respectively, the restriction enzyme recognition sites EcoR1 (GAATTC), Sal1 (GTCGAC) and Sph1 (GCATGC); and V and J were, respectively, V region and J region polynucleotides as described herein. Each template oligonucleotide consisted of a 239 base pair DNA molecule. Sense strand sequences are presented as SEQ ID NOS:872-1560.

TCRG Template Oligonucleotides (SEQ ID NOS:1561-1630). A third set of 70 template oligonucleotides of general formula (I) was designed using human TCRG V and J polynucleotide sequences. Each template oligonucleotide consisted of a 495 base pair DNA molecule. Sense strand sequences are presented as SEQ ID NOS:1561-1630. Details for the 70-oligonucleotide set of TCRG templates (SEQ ID NOS:1561-1630) are representative and were as follows:

Based on previously determined genomic sequences the human TCRG locus was shown to contain 14 Vγ segments that each had a RSS sequence and were therefore regarded as rearrangement-competent. These 14 Vγ segments included six gene segments known to be expressed, three V segments that were classified as having open reading frames, and five V pseudogenes. The Vγ gene segments were linked to five Jγ gene segments. In order to include all possible V+J gene combinations for the 14 V and 5 J segments, 70 (5×14) templates were designed that represented all possible VJ combinations. Each template conformed to the general formula (I) (5'-U1-B1-V-B2-R-(B3)-J-B4-U2-3')(FIG. 1) and thus included nine sections, a 19 base pair (bp) universal adapter (U1), a 16 bp nucleotide tag uniquely identifying each paired combination of V gene and J gene segments (B1), 300 bp of V gene specific sequence (V), a 3 bp stop codon (S), another copy of the 16 bp nucleotide tag (B2), a 6 bp junction tag shared by all molecules (R), nothing for B3, 100 bp of J gene specific sequence (J), a third copy of the 16 bp nucleotide tag (B4), and a 19 bp universal adapter sequence (U2).

Each of the 70 templates (SEQ ID NOS:1561-1630) was amplified individually using oligonucleotide primers (Table 4; SEQ ID NOS:1732-1745) designed to anneal to the universal adapter sequences (U1, U2).

TABLE 4

TCRG Amplification Primers

| Primer Name | 5' Adapter | Sequence | SEQ ID NO: |
|---|---|---|---|
| TCRGV01_dev10 | pGEXf | GGAGGGGAAGGCCCCACAGTGTCTTC | 1732 |
| TCRGV02/3/4/5/8_dev10 | pGEXf | GGAGGGGAAGGCCCCACAGCGTCTTC | 1733 |
| TCRGV05P_dev10 | pGEXf | GGAGGGGAAGACCCCACAGCATCTTC | 1734 |
| TCRGV06_dev10 | pGEXf | GGAGGGGAAGGCCCCACAGCATCTTC | 1735 |
| TCRGV07_dev10 | pGEXf | GGCGGGGAAGGCCCCACAGCATCTTC | 1736 |
| TCRGV09_dev10 | pGEXf | TGAAGTCATACAGTTCCTGGTGTCCAT | 1737 |
| TCRGV10_dev10 | pGEXf | CCAAATCAGGCTTTGGAGCACCTGATCT | 1738 |

TABLE 4-continued

TCRG Amplification Primers

| Primer Name | 5' Adapter | Sequence | SEQ ID NO: |
|---|---|---|---|
| TCRGV11_dev10 | pGEXf | CAAAGGCTTAGAATATTTATTACATGT | 1739 |
| TCRGVA_dev10 | pGEXf | CCAGGTCCCTGAGGCACTCCACCAGCT | 1740 |
| TCRGVB_dev10 | pGEXf | CTGAATCTAAATTATGAGCCATCTGACA | 1741 |
| TCRGJP1_dev10 | pGEXr | GTGAAGTTACTATGAGCTTAGTCCCTTCAGCAAA | 1742 |
| TCRGJP2_dev10 | pGEXr | CGAAGTTACTATGAGCCTAGTCCCTTTTGCAAA | 1743 |
| TCRGJ1/2_dev10 | pGEXr | TGACAACAAGTGTTGTTCCACTGCCAAA | 1744 |
| TCRGJP_dev10 | pGEXr | CTGTAATGATAAGCTTTGTTCCGGGACCAAA | 1745 |

The resulting concentration of each amplified template oligonucleotide product was quantified using a LabChip GX™ capillary electrophoresis system (Caliper Life Sciences, Inc., Hopkinton, Mass.) according to the manufacturer's instructions. The frequencies of occurrence for each of the 70 possible V-J combinations, as determined by sequencing barcodes B1, are shown in Table 5. The 70 amplified template oligonucleotide preparations were normalized to a standard concentration and then pooled.

To verify that all 70 template oligonucleotides were present at substantially equimolar concentrations, the pool was sequenced using the Illumina HiSeq™ sequencing platform according to the manufacturer's recommendations. Briefly, to incorporate platform-specific oligonucleotide sequences into the pooled template oligonucleotides, tailed primers were designed that annealed to the universal priming sites (U1, U2) and that had Illumina Nextera™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 60 bp of the PCR reaction products were sequenced using an Illumina HiSEQ™ sequencer (Illumina, Inc., San Diego, Calif.) and analyzed by assessing the frequency of each 16 bp molecular barcode tag (B1).

A substantially equimolar preparation for the set of 70 distinct template oligonucleotides was calculated to contain approximately 1.4% of each member of the set, and a threshold tolerance of plus or minus ten-fold frequency (0.14-14%) for all species was desired. The quantitative sequencing revealed that the 70 species of adapter-modified template oligonucleotides within the initial pool were not evenly represented.

Accordingly, adjustment of the concentrations of individual template oligonucleotides and reiteration of the quantitative sequencing steps are conducted until each molecule is present within the threshold tolerance concentration (0.14-14%).

TABLE 5

Relative Representation (number of occurrences of indicated V-J combination) of amplification products of each TCRG VJ pair (14 V x 5 J) in pre-amplification Template Pool

| Count of Jseg B Labels | TCRGJ | TCRGJ2 | TCRGJP | TCRGJP1 | TCRGJP2 | #N/A | Grand Total |
|---|---|---|---|---|---|---|---|
| TCRGV01 | 17 | 308 | 1315 | 741 | 822 | 44 | 3247 |
| TCRGV02 | 630 | 781 | 2394 | 2009 | 122 | 65 | 6001 |
| TCRGV03 | 250 | 166 | 2119 | 157 | 1105 | 51 | 3848 |
| TCRGV04 | 777 | 37 | 2031 | 1490 | 1443 | 76 | 5854 |
| TCRGV05 | 323 | 93 | 2571 | 716 | 150 | 63 | 3916 |
| TCRGV05P | 294 | 1161 | 2946 | 1552 | 530 | 111 | 6594 |
| TCRGV06 | 164 | 1280 | 1809 | 401 | 23 | 40 | 3717 |
| TCRGV07 | 16 | 234 | 1849 | 1697 | 93 | 78 | 3967 |
| TCRGV08 | 2523 | 653 | 944 | 170 | 134 | 57 | 4481 |
| TCRGV09 | 55 | 1004 | 2057 | 124 | 228 | 42 | 3510 |
| TCRGV10 | 351 | 690 | 814 | 384 | 466 | 36 | 2741 |
| TCRGV11 | 505 | 648 | 639 | 330 | 181 | 39 | 2342 |
| TCRGVA | 199 | 475 | 112 | 272 | 437 | 12 | 1507 |
| TCRGVB | 210 | 20 | 423 | 874 | 917 | 24 | 2468 |
| #N/A | 77 | 118 | 309 | 150 | 106 | 531 | 1291 |
| Grand Total | 6391 | 7668 | 22332 | 11067 | 6757 | 1269 | 55484 |

Example 2

Detection of TCRB V Gene Amplification Bias

This example describes how a set of 689 human TCRB template oligonucleotides of general formula (I) was assembled by tiling together four single stranded oligonucleotides of 50-90 nucleotides each to generate a template set containing hybridization targets for all possible V–J combinations in a set of oligonucleotide primers that was capable of amplifying human TCRB sequences. The set of template oligonucleotides was then used to characterize the relative amplification efficiencies of a set of TCRB V and J amplification primers.

A set of TCRB 689 template oligonucleotides containing polynucleotide sequences representing all possible productively rearranged V and J combinations for human TCRB chains was synthesized by "tiling" together four single-stranded DNA primers in a standard PCR reaction. Briefly, two 90 bp fragments (one in "forward" orientation and the other in "reverse") were designed for each TCRB V gene segment, one 90 bp fragment (in "reverse" orientation) was designed for each TCRB J gene segment, and a 50 bp (forward) linker molecule was designed to link together the V and J gene fragments. In total, 52 V forward and 52 V reverse, 13 J reverse, and 689 linker molecules were designed. The two 90 bp fragments (one forward, one reverse) that corresponded to each of the V gene segments had 39 bp of complementary overlapping sequence. One end of each V reverse fragment had 25 bp of complementary sequence which overlapped with the 50 bp linker molecule. The remaining 25 bp in each of the linker molecules was a sequence that complementarily overlapped with one end of the J molecule. The molecules were designed so that the complementary sequences would anneal to one another and form double stranded DNA to which Taq polymerase could bind and enzymatically extend the molecule.

Each PCR reaction to assemble the tiled molecules used QIAGEN Multiplex PCR master mix (QIAGEN part number 206145, Qiagen, Valencia, Calif.), 10% Q-solution (QIAGEN), and the four single-stranded oligonucleotide sequences (two TCRB V, a TCRB J and a linker, as described above). The two external molecules (one V forward and one J reverse) were added at a final concentration of 1 µM each while the two internal molecules, (one V reverse and the forward linker), were each added at a final concentration of 0.01 µM. The thermocycler conditions were: 95° C. for 15 minutes, followed by 35 cycles of 94° C. for 30 seconds, 59° C. for 30 seconds, and 72° C. for 1 minute, followed by 1 cycle at 72° C. for 10 minutes. After synthesis, the molecules were quantified by the LabChip GX™ capillary electrophoresis system (Caliper Life Sciences, Inc., Hopkinton, Mass.) according to the manufacturer's instructions and the concentration (in ng/µl) of each resulting band was calculated using Caliper LabChip GX software.

The nucleotide sequences for the resulting set of 689 TCRB template oligonucleotides are set forth in SEQ ID NOS:872-1560. In SEQ ID NOS:872-1560, each distinct V region sequence was identified by a unique barcode sequence of eight nucleotides, as shown in Table 7. All 689 templates were normalized to a standard concentration of 25 ng/µl, and then pooled. The resulting pool was used for the TCRB assays described herein to detect biased (non-uniform) utilization of TCRB amplification primers during amplification of the 689-template oligonucleotide set (SEQ ID NOS:872-1560).

Each of the 689 templates was present in the template oligonucleotide pool at experimentally as close as possible to equal molar concentration, and the pool was used as template for the TCRB amplification PCR reaction using an equimolar mixture of 52 TCRB V region primers that included an Illumina adapter-compatible sequence (SEQ ID NOS:1753-1804, Table 6) and an equimolar mix of 13 TCRB J region primers (SEQ ID NOS:1631-1643, Table 1). The members of the pool of 689 templates were amplified using an equimolar pool of the 52 TCRB JβR (forward) primers (the "JF pool") and an equimolar pool of the 13 TCRB JβR (reverse) primers (the "JR pool") as shown in Table 1 (SEQ ID NOS:1.631-1695). Polymerase chain reactions (PCR) (50 µL each) were set up at 1.0 µM VF pool (22 nM for each unique TCRB VβF primer), 1.0 µM JR pool (77 nM for each unique TCRB JβR primer), 1 µM QIAGEN Multiplex PCR master mix ((NAGEN part number 206145, Qiagen Corp., Valencia, Calif.), 10% Q-solution (QIAGEN), and 16 ng/µL genomic DNA (gDNA). The following thermal cycling conditions were used in a C100 thermal cycler (Bio-Rad Laboratories, Hercules, Calif., USA): one cycle at 95° C. for 15 minutes, 25 to 40 cycles at 94° C. for 30 seconds, 59° C. for 30 seconds, and 72° C. for one minute, followed by one cycle at 72° C. for 10 minutes. To sample millions of rearranged TCRβ CDR3 loci, 12 to 20 wells of PCR were performed for each library. As noted above, the V and J primers included a tail that corresponded to, and was compatible with, Illumina adapters for sequencing.

Figure 2:
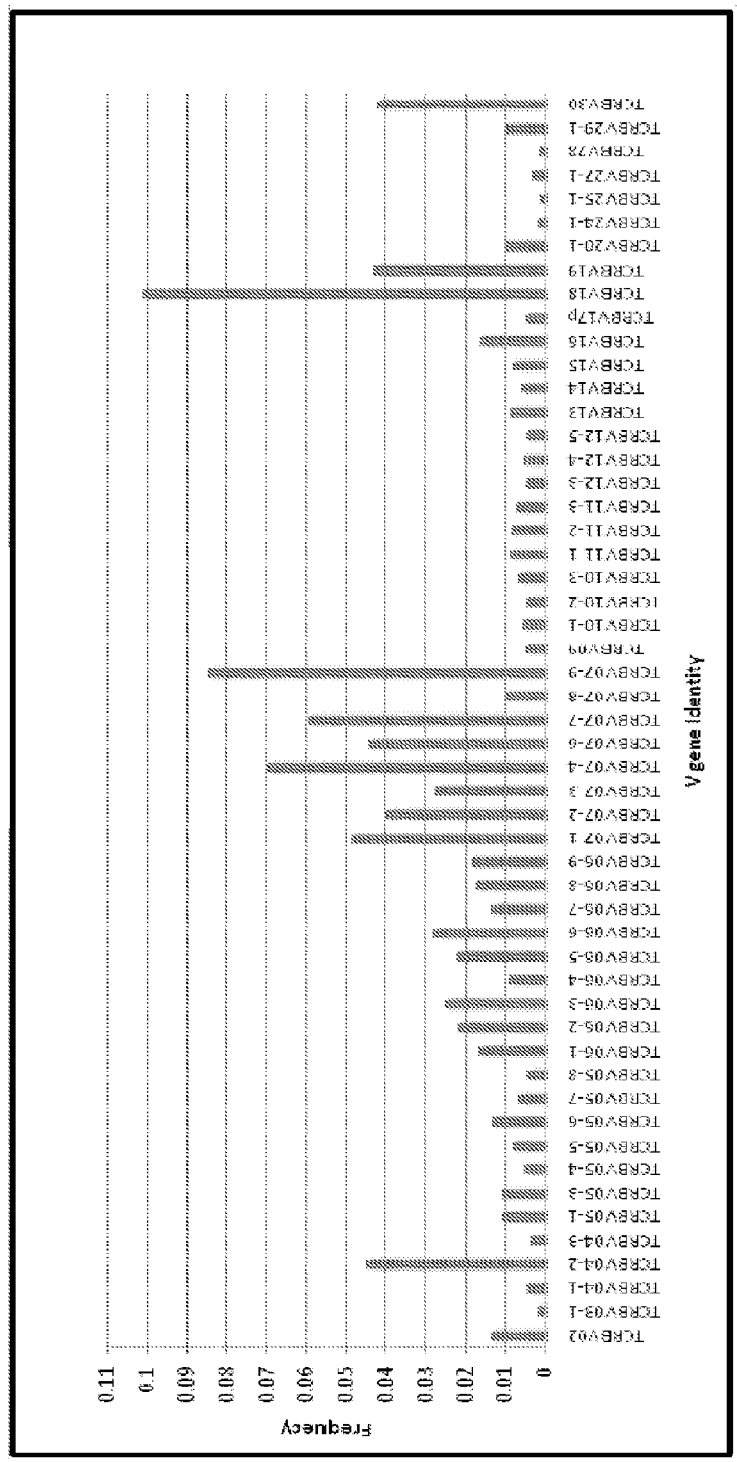
FIG. 2 shows post-amplification frequencies of individual TCRB V gene segment sequences amplified from a standardizing oligonucleotide template composition (an equimolar pool of the templates set forth in SEQ ID NOS:872-1560) using an equimolar (unadjusted) pool of 52 PCR primers (SEQ ID NOS:1753-1804) and quantitatively sequenced on the Illumina HiSeq™ DNA sequencer. Frequency in the absence of bias was calculated as 0.0188.

Amplification products were quantitatively sequenced on an Illumina HiSeq™ sequencer. A 60-base pair region of each product molecule was sequenced using standard J sequencing primers (Table 3) starting from the J molecules. The frequencies of occurrence of each TCRB sequence in the reaction products are shown in FIG. 2, from which it was apparent that not all TCRB sequences had been amplified to a comparable degree.

TABLE 6

TCRB Amplification Primers

| Primer Name | Primer Sequence | Adjusted Relative Primer Molar Ratio | SEQ ID NO: |
|---|---|---|---|
| TRB2V10-1 | CAA GCA GAA GAC GGC ATA CGA GCT CTT CCG ATC TAA CAA AGG AGA AGT CTC AGA TGG CTA CAG | 0.77 | 1753 |
| TRB2V10-2 | CAA GCA GAA GAC GGC ATA CGA GCT CTT CCG ATC TGA TAA AGG AGA AGT CCC CGA TGG CTA TGT | 1.57 | 1754 |

TABLE 6-continued

TCRB Amplification Primers

| Primer Name | Primer Sequence | Adjusted Relative Primer Molar Ratio | SEQ ID NO: |
|---|---|---|---|
| TRB2V10-3 | CAA GCA GAA GAC GGC ATA CGA GCT CTT CCG ATC TGA CAA AGG AGA AGT CTC AGA TGG CTA TAG | 2.76 | 1755 |
| TRB2V11-123 | CAA GCA GAA GAC GGC ATA CGA GCT CTT CCG ATC TCT AAG GAT CGA TTT TCT GCA GAG AGG CTC | 1.88 | 1756 |
| TRB2V12-1 | CAA GCA GAA GAC GGC ATA CGA GCT CTT CCG ATC TTT GAT TCT CAG CAC AGA TGC CTG ATG T | 1 | 1757 |
| TRB2V12-2 | CAA GCA GAA GAC GGC ATA CGA GCT CTT CCG ATC TGC GAT TCT CAG CTG AGA GGC CTG ATG G | 1 | 1758 |
| TRB2V12-3/4 | CAA GCA GAA GAC GGC ATA CGA GCT CTT CCG ATC TTC GAT TCT CAG CTA AGA TGC CTA ATG C | 3.24 | 1759 |
| TRB2V12-5 | CAA GCA GAA GAC GGC ATA CGA GCT CTT CCG ATC TTT CTC AGC AGA GAT GCC TGA TGC AAC TTT A | 1.82 | 1760 |
| TRB2V13 | CAA GCA GAA GAC GGC ATA CGA GCT CTT CCG ATC TCT GAT CGA TTC TCA GCT CAA CAG TTC AGT | 2.14 | 1761 |
| TRB2V14 | CAA GCA GAA GAC GGC ATA CGA GCT CTT CCG ATC TTC TTA GCT GAA AGG ACT GGA GGG ACG TAT | 1.65 | 1762 |
| TRB2V15 | CAA GCA GAA GAC GGC ATA CGA GCT CTT CCG ATC TGC CGA ACA CTT CTT TCT GCT TTC TTG AC | 3.77 | 1763 |
| TRB2V16 | CAA GCA GAA GAC GGC ATA CGA GCT CTT CCG ATC TTT CAG CTA AGT GCC TCC CAA ATT CAC CCT | 1.40 | 1764 |
| TRB2V17 | CAA GCA GAA GAC GGC ATA CGA GCT CTT CCG ATC TAT TCA CAG CTG AAA GAC CTA ACG GAA CGT | 2.87 | 1765 |
| TRB2V18 | CAA GCA GAA GAC GGC ATA CGA GCT CTT CCG ATC TAT TTT CTG CTG AAT TTC CCA AAG AGG GCC | 0.80 | 1766 |
| TRB2V19 | CAA GCA GAA GAC GGC ATA CGA GCT CTT CCG ATC TTA TAG CTG AAG GGT ACA GCG TCT CTC GGG | 0.84 | 1767 |
| TRB2V2 | CAA GCA GAA GAC GGC ATA CGA GCT CTT CCG ATC TTT CGA TGA TCA ATT CTC AGT TGA AAG GCC | 1.02 | 1768 |
| TRB2V20-1 | CAA GCA GAA GAC GGC ATA CGA GCT CTT CCG ATC TAT GCA AGC CTG ACC TTG TCC ACT CTG ACA | 1.66 | 1769 |
| TRB2V23-1 | CAA GCA GAA GAC GGC ATA CGA GCT CTT CCG ATC TGA TTC TCA TCT CAA TGC CCC AAG AAC GC | 1 | 1770 |
| TRB2V24-1 | CAA GCA GAA GAC GGC ATA CGA GCT CTT CCG ATC TAT CTC TGA TGG ATA CAG TGT CTC TCG ACA | 4.01 | 1771 |
| TRB2V25-1 | CAA GCA GAA GAC GGC ATA CGA GCT CTT CCG ATC TTT TCC TCT GAG TCA ACA GTC TCC AGA ATA | 1.29 | 1772 |

TABLE 6-continued

TCRB Amplification Primers

| Primer Name | Primer Sequence | Adjusted Relative Primer Molar Ratio | SEQ ID NO: |
|---|---|---|---|
| TRB2V26 | CAA GCA GAA GAC GGC ATA CGA GCT CTT CCG ATC TCT CTG AGA GGT ATC ATG TTT CTT GAA ATA | 1 | 1773 |
| TRB2V27 | CAA GCA GAA GAC GGC ATA CGA GCT CTT CCG ATC TTC CTG AAG GGT ACA AAG TCT CTC GAA AAG | 4.22 | 1774 |
| TRB2V28 | CAA GCA GAA GAC GGC ATA CGA GCT CTT CCG ATC TTC CTG AGG GGT ACA GTG TCT CTA GAG AGA | 2.37 | 1775 |
| TRB2V29-1 | CAA GCA GAA GAC GGC ATA CGA GCT CTT CCG ATC TCA TCA GCC GCC CAA ACC TAA CAT TCT CAA | 1.50 | 1776 |
| TRB2V2P | CAA GCA GAA GAC GGC ATA CGA GCT CTT CCG ATC TCC TGA ATG CCC TGA CAG CTC TCG CTT ATA | 1 | 1777 |
| TRB2V3-1 | CAA GCA GAA GAC GGC ATA CGA GCT CTT CCG ATC TCC TAA ATC TCC AGA CAA AGC TCA CTT AAA | 3.35 | 1778 |
| TRB2V3-2 | CAA GCA GAA GAC GGC ATA CGA GCT CTT CCG ATC TCT CAC CTG ACT CTC CAG ACA AAG CTC AT | 1 | 1779 |
| TRB2V30 | CAA GCA GAA GAC GGC ATA CGA GCT CTT CCG ATC TGA CCC CAG GAC CGG CAG TTC ATC CTG AGT | 1.48 | 1780 |
| TRB2V4-1 | CAA GCA GAA GAC GGC ATA CGA GCT CTT CCG ATC TCT GAA TGC CCC AAC AGC TCT CTC TTA AAC | 3.32 | 1781 |
| TRB2V4-2/3 | CAA GCA GAA GAC GGC ATA CGA GCT CTT CCG ATC TCT GAA TGC CCC AAC AGC TCT CAC TTA TTC | 3.11 | 1782 |
| TRB2V5-1 | CAA GCA GAA GAC GGC ATA CGA GCT CTT CCG ATC TTG GTC GAT TCT CAG GGC GCC AGT TCT CTA | 1.27 | 1783 |
| TRB2V5-3 | CAA GCA GAA GAC GGC ATA CGA GCT CTT CCG ATC TTA ATC GAT TCT CAG GGC GCC AGT TCC ATG | 1.75 | 1784 |
| TRB2V5-4 | CAA GCA GAA GAC GGC ATA CGA GCT CTT CCG ATC TTC CTA GAT TCT CAG GTC TCC AGT TCC CTA | 1.58 | 1785 |
| TRB2V5-5 | CAA GCA GAA GAC GGC ATA CGA GCT CTT CCG ATC TAA GAG GAA ACT TCC CTG ATC GAT TCT CAG C | 0.99 | 1786 |
| TRB2V5-6 | CAA GCA GAA GAC GGC ATA CGA GCT CTT CCG ATC TGG CAA CTT CCC TGA TCG ATT CTC AGG TCA | 0.69 | 1787 |
| TRB2V5-8 | CAA GCA GAA GAC GGC ATA CGA GCT CTT CCG ATC TGG AAA CTT CCC TCC TAG ATT TTC AGG TCG | 3.30 | 1788 |
| TRB2V6-1 | CAA GCA GAA GAC GGC ATA CGA GCT CTT CCG ATC TGT CCC AAT GGC TAC AAT GTC TCC AGA TT | 1.74 | 1789 |

TABLE 6-continued

TCRB Amplification Primers

| Primer Name | Primer Sequence | Adjusted Relative Primer Molar Ratio | SEQ ID NO: |
|---|---|---|---|
| TRB2V6-2/3 | CAA GCA GAA GAC GGC ATA CGA GCT CTT CCG ATC TGC CAA AGG AGA GGT CCC TGA TGG CTA CAA | 1.59 | 1790 |
| TRB2V6-4 | CAA GCA GAA GAC GGC ATA CGA GCT CTT CCG ATC TGT CCC TGA TGG TTA TAG TGT CTC CAG AGC | 1.48 | 1791 |
| TRB2V6-5 | CAA GCA GAA GAC GGC ATA CGA GCT CTT CCG ATC TAA GGA GAA GTC CCC AAT GGC TAC AAT GTC | 0.45 | 1792 |
| TRB2V6-6 | CAA GCA GAA GAC GGC ATA CGA GCT CTT CCG ATC TGA CAA AGG AGA AGT CCC GAA TGG CTA CAA C | 0.41 | 1793 |
| TRB2V6-7 | CAA GCA GAA GAC GGC ATA CGA GCT CTT CCG ATC TGT TCC AAT GGC TAC AAT GTC TCC AGA TC | 2.23 | 1794 |
| TRB2V6-8 | CAA GCA GAA GAC GGC ATA CGA GCT CTT CCG ATC TCT CTA GAT TAA ACA CAG AGG ATT TCC CAC | 1.18 | 1795 |
| TRB2V6-9 | CAA GCA GAA GAC GGC ATA CGA GCT CTT CCG ATC TAA GGA GAA GTC CCC GAT GGC TAC AAT GTA | 0.96 | 1796 |
| TRB2V7-1 | CAA GCA GAA GAC GGC ATA CGA GCT CTT CCG ATC TTC CCC GTG ATC GGT TCT CTG CAC AGA GGT | 0.85 | 1797 |
| TRB2V7-2 | CAA GCA GAA GAC GGC ATA CGA GCT CTT CCG ATC TAG TGA TCG CTT CTC TGC AGA GAG GAC TGG | 0.64 | 1798 |
| TRB2V7-3 | CAA GCA GAA GAC GGC ATA CGA GCT CTT CCG ATC TGG CTG CCC AAC GAT CGG TTC TTT GCA GT | 0.84 | 1799 |
| TRB2V7-4 | CAA GCA GAA GAC GGC ATA CGA GCT CTT CCG ATC TGG CGG CCC AGT GGT CGG TTC TCT GCA GAG | 0.48 | 1800 |
| TRB2V7-6/7 | CAA GCA GAA GAC GGC ATA CGA GCT CTT CCG ATC TAT GAT CGG TTC TCT GCA GAG AGG CCT GAG G | 1.01 | 1801 |
| TRB2V7-8 | CAA GCA GAA GAC GGC ATA CGA GCT CTT CCG ATC TGC TGC CCA GTG ATC GCT TCT TTG CAG AAA | 1.57 | 1802 |
| TRB2V7-9 | CAA GCA GAA GAC GGC ATA CGA GCT CTT CCG ATC TGG TTC TCT GCA GAG AGG CCT AAG GGA TCT | 0.49 | 1803 |
| TRB2V9 | CAA GCA GAA GAC GGC ATA CGA GCT CTT CCG ATC TGT TCC CTG ACT TGC ACT CTG AAC TAA AC | 3.46 | 1804 |

TABLE 7

Barcode sequences used to identify TCRB V Regions in SEQ ID NOS: 872-1560

| TCRBV region name of 8 bp barcode | Nucleotide Sequence | SEQ ID NO |
|---|---|---|
| TCRBV2_8bpBC | CAAGGTCA | SEQ ID NO: 6375 |
| TCRBV3-1_8bpBC | TACGTACG | SEQ ID NO: 6376 |
| TCRBV4-1_8bpBC | TACGCGTT | SEQ ID NO: 6377 |
| TCRBV4-2_8bpBC | CTCAGTGA | SEQ ID NO: 6378 |
| TCRBV4-3_8bpBC | GTGTCTAC | SEQ ID NO: 6379 |
| TCRBV5-1_8bpBC | AGTACCGA | SEQ ID NO: 6380 |
| TCRBV5-3_8bpBC | TTGCCTCA | SEQ ID NO: 6381 |
| TCRBV5-4_8bpBC | TCGTTAGC | SEQ ID NO: 6382 |
| TCRBV5-5_8bpBC | TGGACATG | SEQ ID NO: 6383 |
| TCRBV5-6_8bpBC | AGGTTGCT | SEQ ID NO: 6384 |
| TCRBV5-7_8bpBC | GTACAGTG | SEQ ID NO: 6385 |
| TCRBV5-8_8bpBC | ATCCATGG | SEQ ID NO: 6386 |
| TCRBV6-1_8bpBC | TGATGCGA | SEQ ID NO: 6387 |
| TCRBV6-2_8bpBC | GTAGCAGT | SEQ ID NO: 6388 |
| TCRBV6-3_8bpBC | GGATCATC | SEQ ID NO: 6389 |
| TCRBV6-4_8bpBC | GTGAACGT | SEQ ID NO: 6390 |
| TCRBV6-5_8bpBC | TGTCATCG | SEQ ID NO: 6391 |
| TCRBV6-6_8bpBC | AGGCTTGA | SEQ ID NO: 6392 |
| TCRBV6-7_8bpBC | ACACACGT | SEQ ID NO: 6393 |
| TCRBV6-8_8bpBC | TCCACAGT | SEQ ID NO: 6394 |
| TCRBV6-9_8bpBC | CAGTCTGT | SEQ ID NO: 6395 |
| TCRBV7-1_8bpBC | TCCATGTG | SEQ ID NO: 6396 |
| TCRBV7-2_8bpBC | TCACTGCA | SEQ ID NO: 6397 |
| TCRBV7-3_8bpBC | CAAGTCAC | SEQ ID NO: 6398 |
| TCRBV7-4_8bpBC | TAGACGGA | SEQ ID NO: 6399 |
| TCRBV7-6_8bpBC | GAGCGATA | SEQ ID NO: 6400 |
| TCRBV7-7_8bpBC | CTCGAGAA | SEQ ID NO: 6401 |
| TCRBV7-8_8bpBC | ATGACACC | SEQ ID NO: 6402 |
| TCRBV7-9_8bpBC | CTTCACGA | SEQ ID NO: 6403 |
| TCRBV9_8bpBC | CGTAGAGT | SEQ ID NO: 6404 |
| TCRBV10-1_8bpBC | TCGTCGAT | SEQ ID NO: 6405 |
| TCRBV10-2_8bpBC | AGCTAGTG | SEQ ID NO: 6406 |
| TCRBV10-3_8bpBC | TGAGACCT | SEQ ID NO: 6407 |
| TCRBV11-1_8bpBC | GATGGCTT | SEQ ID NO: 6408 |
| TCRBV11-2_8bpBC | GCATCTGA | SEQ ID NO: 6409 |
| TCRBV11-3_8bpBC | GACACTCT | SEQ ID NO: 6410 |
| TCRBV12-3_8bpBC | TGCTACAC | SEQ ID NO: 6411 |
| TCRBV12-4_8bpBC | TCAGCTTG | SEQ ID NO: 6412 |
| TCRBV12-5_8bpBC | TTCGGAAC | SEQ ID NO: 6413 |
| TCRBV13_8bpBC | GCAATTCG | SEQ ID NO: 6414 |
| TCRBV14_8bpBC | CAAGAGGT | SEQ ID NO: 6415 |
| TCRBV15_8bpBC | GAATGGAC | SEQ ID NO: 6416 |
| TCRBV16_8bpBC | AACTGCCA | SEQ ID NO: 6417 |
| TCRBV17p_8bpBC | CCTAGTAG | SEQ ID NO: 6418 |
| TCRBV18_8bpBC | CTGACGTT | SEQ ID NO: 6419 |
| TCRBV19_8bpBC | TGCAGACA | SEQ ID NO: 6420 |
| TCRBV20-1_8bpBC | AGTTGACC | SEQ ID NO: 6421 |
| TCRBV24-1_8bpBC | GTCTCCTA | SEQ ID NO: 6422 |
| TCRBV25-1_8bpBC | CTGCAATC | SEQ ID NO: 6423 |
| TCRBV27-1_8bpBC | TGAGCGAA | SEQ ID NO: 6424 |
| TCRBV28_8bpBC | TTGGACTG | SEQ ID NO: 6425 |
| TCRBV29-1_8bpBC | AGCAATCC | SEQ ID NO: 6426 |
| TCRBV30_8bpBC | CGAACTAC | SEQ ID NO: 6427 |

Using the data that were obtained to generate FIG. 2, as described above, the cross-amplification capability (ability to amplify a V gene segment other than the one for which the primer was specifically designed on the basis of annealing sequence complementarity) was assessed for each amplification primer that had been designed to anneal to a specific V gene segment. 52 independent amplification primer pools were prepared, where each primer pool had 51 of the 52 TCRB V region primers of Table 6 pooled at equimolar concentrations, and the $52^{nd}$ TCRB V region primer present in the pool at twice the molar concentration of the other 51 primers. A separate amplification primer pool was prepared so that there was one pool for each of the 52 V primers in which a single primer was present at twice the concentration of the other primers, resulting in 52 unique primer pools. 52 separate amplification reactions were then set up, one for each of the unique amplification primer pools, with each reaction using the set of 689 template oligonucleotides (SEQ ID NOS: 872-1560) described above. Template oligonucleotides were present at equimolar concentration relative to one another. Amplification and sequencing were conducted using the conditions described above. The results are shown in FIG. 3.

Figure 3:
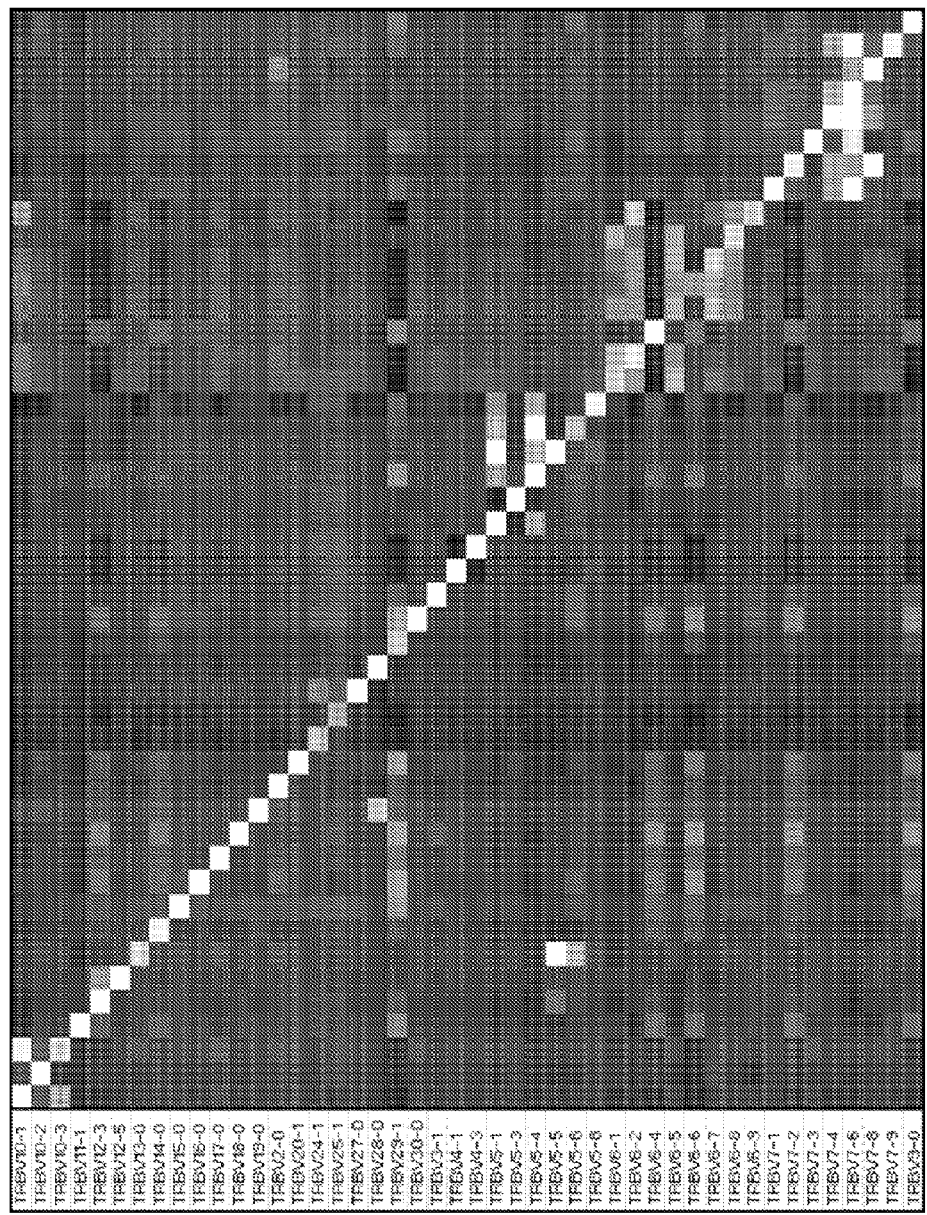
FIG. 3 shows the results of quantitative sequencing following cross-amplification of template oligonucleotides using TCRB V region-specific primers. Y-axis indicates individual amplification primers (SEQ ID NOS:1753-1804) that were present in each separate amplification reaction at twice the molar concentration (2×) of the other primers from the same primer set, for amplification of a standardizing oligonucleotide template composition (an equimolar pool of the templates set forth in SEQ ID NOS:872-1560); X-axis is not labeled but data points are presented in the same order as for Y-axis, with X-axis representing corresponding amplified V gene templates as identified by quantitative sequencing. Black squares indicate no change in degree of amplification with the respective primer present at 2× relative to equimolar concentrations of all other primers; white squares indicate 10-fold increase in amplification; grey squares indicate intermediate degrees (on a greyscale gradient) of amplification between zero and 10-fold. Diagonal line of white squares indicates that 2× concentration for a given primer resulted in about 10-fold increase in amplification of the respective template for most primers. Off-diagonal white squares indicate non-corresponding templates to which certain primers were able to anneal and amplify.

In FIG. 3, black squares indicated no change in the degree of amplification with the respective indicated TCRB V region-specific primer present at twice the concentration relative to equimolar concentrations of all other primers; white squares indicated a 10-fold increase in amplification; grey squares indicated intermediate degrees (on a greyscale gradient) of amplification between zero and 10-fold. The diagonal line indicated that doubling the molar concentration for a given primer resulted in about a 10-fold increase in the amplification of the respective template oligonucleotide having the specific annealing target sequence, in the case of most of the TCRB V regions primers that were tested. The off-diagonal white squares indicated non-corresponding templates to which certain primers were able to anneal and amplify.

Where one or more primers exhibited amplification potential that was significantly greater or lower than an acceptable range of amplification potential (e.g., a designated uniform amplification potential range), further adjustment of the concentrations of individual primer oligonucleotides and reiteration of the template amplification and quantitative sequencing steps were conducted, until each species of product molecule was present within a desired range that was indicative of correction of the non-uniform amplification potential among the primers within an amplification primer set.

Accordingly, primer concentrations were adjusted as indicated in Table 6, in order to determine whether biased amplification results that were apparent in FIGS. 2 and 3 could be reduced in severity by increasing or decreasing the relative presence of, respectively, highly efficient or poorly efficient amplification primers. For multiplexed PCR using an adjusted primer set, the V gene primer sequences remained the same (sequence reported in table 6), however the relative concentration of each primer was either increased, if the primer under-amplified its template (FIG. 3), or decreased if the primer over-amplified its template (FIG. 3). The adjusted mixture of amplification primers was then used in a PCR to amplify the template composition containing, in equimolar amounts, the set of 689 template oligonucleotides (SEQ ID NOS:872-1560) that were used to generate the data in FIGS. 2 and 3.

Figure 4:
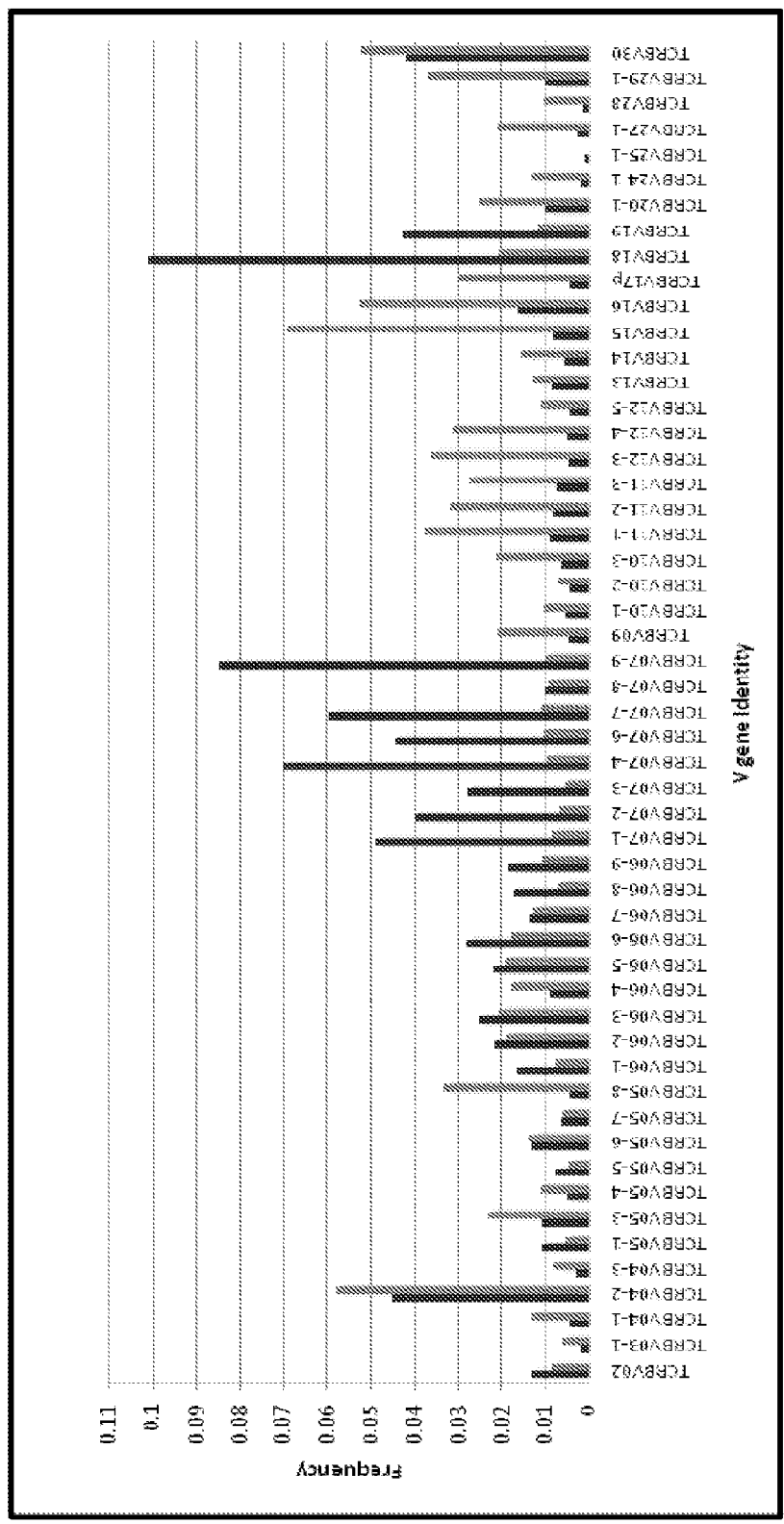
FIG. 4 shows post-amplification frequencies of individual TCRB V gene segment sequences amplified from a standardizing oligonucleotide template composition (an equimolar pool of the templates set forth in SEQ ID NOS:872-1560), using equimolar concentrations of all members of a TCRB amplification primer set (SEQ ID NOS:1753-1804) prior to adjusting for primer utilization bias (black bars, all V-region primers present in equimolar concentrations), and using the same primer set (SEQ ID NOS:1753-1804) after adjusting multiple individual primer concentrations to compensate for bias (grey bars, concentrations of highly efficient primers were reduced and concentrations of poorly efficient primers were increased, see Table 6). Post-amplification frequencies were determined by quantitative sequencing on the Illumina HiSeq™ DNA sequencer.

Amplification and quantitative sequencing were performed as described above and the results are shown in FIG. 4, which compares the frequency at which each indicated amplified V region sequence-containing product was obtained when all amplification primers were present at equimolar concentrations (black bars) to the frequency at which each such product was obtained after the concentrations of the amplification primers were adjusted (grey bars) to the concentrations as indicated in Table 6.

Additional hs-TCRB primer sequences are found at SEQ ID NOs. 6192-6264.

Example 3

Correcting Non-Uniform Amplification Potential (PCR Bias) in TCR-Amplifying Oligonucleotide Primer Sets Diverse TCR amplification primers are designed to amplify every possible combination of rearranged TCR V and J gene segments in a biological sample that contains lymphoid cell DNA from a subject. A preparation containing equimolar concentrations of the diverse amplification primers is used in multiplexed PCR to amplify a diverse template composition that comprises equimolar concentrations of TCR-specific template oligonucleotides according to formula (I) with at least one template representing every possible V–J combination for the TCR locus. The amplification products are quantitatively sequenced and the frequency of occurrence of each unique V–J product sequence is obtained from the frequency of occurrence of each 16 bp molecular barcode sequence (B in formula (I)) that uniquely identifies each V–J combination.

For TCRG, the TCRG template oligonucleotides (SEQ ID NOS:1561-1630) are amplified using TCRG V- and J-specific primers (SEQ ID NOS:1732-1745, Table 4). J primer independence of respectively paired V primers is identified by separately amplifying each of the eight TCRG V gene segment specific primers with a pool of the five J gene segment specific primers. The amplification products are quantitatively sequenced on an Illumina HiSeq™ sequencing platform and the frequency of occurrence of the internal 16 bp barcode sequences (B) that uniquely identify specific V–J combinations permit quantification of each V–J pair. V primer independence of respectively paired J primers is identified by performing the inverse reaction, i.e., by separately amplifying each of the five TCRG J gene segment primers with a pool of the eight V gene segment specific primers.

To test if TCRG V primers or J primers cross-amplify (e.g., whether gene segment specific primers amplify non-specifically, for instance, to test if the V primer specifically designed to amplify TCRG V7 segments is able to amplify both TCRG V6 and TCRG V7 V gene segments), independent primer pools are generated that contain equimolar concentrations of all but one of the primers, and the omitted primer is then added to the pool at twice the molar concentration of all other primers. The primers are then used to amplify a template composition that comprises a plurality of template oligonucleotides of general formula (I) as described herein, using TCRG V and J gene sequences in, respectively, the V and J polynucleotides of formula (I). Quantitative sequencing reveals the identities of any one or more templates that are over represented among the amplification products when a single amplification primer is present at twice the concentration of all other primers in the pool of primers. The primer mixture is then adjusted to increase or decrease the relative concentrations of one or more primers, to obtain amplification frequencies in iterative rounds that are within acceptable quantitative tolerances. The adjusted primer mixture so obtained is regarded as having been corrected to reduce non-uniform amplification potential among the members of the primer set.

To determine whether a corrected primer mixture exhibits unbiased amplification potential when used to amplify rearranged TCR template DNA in a biological sample from lymphoid cells of a subject, the artificial template compositions as described herein are prepared with all VJ pairs present at similar frequency, and also with varying ratios of the relative representation of certain VJ pairs. Each type of template preparation is separately tested as an amplification template for an amplification primer set that has been corrected to reduce non-uniform amplification potential among certain members of the primer set. Quantitative sequence determination of amplification products identifies that the relative quantitative representation of specific sequences in the template preparation is reflected in the relative quantitative representation of specific sequences among the amplification products.

As an alternative to the iterative process described above, or in addition to such iterative amplification steps followed by quantitative sequencing, amplification bias can also be corrected computationally. According to this computational approach, the starting frequency of each of the species of template oligonucleotide sequences in the synthesized template composition is known. The frequency of each of these species of oligonucleotide sequences among the amplification products that are obtained following PCR amplification is determined by quantitative sequencing. The difference between the relative frequencies of the template oligonucleotide sequences prior to PCR amplification and their frequencies following PCR amplification is the "PCR bias." This difference is the amplification bias introduced during amplification, for example, as a consequence of different amplification efficiencies among the various amplification primers.

As quantitatively determined for each known template oligonucleotide sequence, the PCR bias for each primer is used to calculate an amplification bias (normalization) factor by which the observed frequency for each amplification product is corrected to reflect the actual frequency of the respective template sequence in the template composition. If PCR bias for an amplification primer set is empirically detected using the present template composition as being within a factor of 10, then the bias can be computationally corrected in amplification products obtained when the same amplification primer set is used to amplify a DNA sample of unknown composition. Improved accuracy in the quantification of template species in the DNA sample is thereby obtained.

Because V and J primers are empirically tested and shown to be independent, an amplification bias factor can be derived for each V species and for each J species, and an amplification factor for each VJ species pair is not necessary. Accordingly, the amplification bias factor for each V species and J species is derived using the present template composition. By the present method, the frequencies of the V and J gene sequences in the template composition are known (or can be calculated based on knowledge of the concentrations of each template oligonucleotide species in the template composition as synthesized) prior to PCR amplification. After PCR amplification, quantitative sequencing is used to detect the frequency of each V and J gene segment sequence in the amplification products. For each sequence, the difference in gene segment frequency is the amplification bias:

Initial Frequency/final frequency=amplification bias factor

Amplification bias factors are calculated for every V gene segment and every J gene segment. These amplification factors, once calculated, can be applied to samples for which the starting frequency of V and J genes is unknown.

In a mixed template population (such as a complex DNA sample obtained from a biological source that comprises DNA from lymphoid cells that are presumed to contain rearranged adaptive immune receptor encoding DNA, or a complex DNA sample which additionally comprises DNA from other cells lacking such rearrangements), where the starting frequency of each V and J gene segment is unknown, the calculated amplification factors for a primer set that has been characterized using the present template composition can be used to correct for residual PCR amplification bias. For each species of sequenced amplification product molecule, the V and J genes that are used by the molecule are determined based on sequence similarity. To correct for amplification bias, the number of times the molecule was sequenced is multiplied by both the correct V and J amplification factors. The resulting sequence count is the computationally "normalized" set.

Example 4

Generation of Additional Template Compositions

Additional template compositions were designed and produced essentially according to the methodologies described above.

V and J Polynucleotides. TCRB V and J polynucleotide sequences were generated for inclusion in the herein described plurality of template oligonucleotides and are set forth in sets of 68 TCRB V and J SEQ ID NOS, respectively, as shown in FIGS. 5a-5l as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13.

TCRG V and J polynucleotide sequences were generated for inclusion in the herein described plurality of template oligonucleotides and are set forth in sets of 14 TCRG V and J SEQ ID NOS, respectively, as set forth in FIGS. 6a-6b as TCRG V/J set 1, TCRG V/J set 2, TCRG V/J set 3, TCRG V/J set 4 and TCRG V/J set 5.

IGH V and J polynucleotide sequences were generated for inclusion in the herein described plurality of template oligonucleotides and are set forth in sets of 127 IGH V and J SEQ ID NOS, respectively, as set forth in FIGS. 7a-7m as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9.

Template Compositions. A template composition was prepared for standardizing the amplification efficiency of TCRB amplification primer sets. The composition comprised a plurality of template oligonucleotides having a plurality of oligonucleotide sequences of general formula (I). The TCRB template composition comprising 858 distinct template oligonucleotides is disclosed in the Sequence Listing in SEQ ID NOS:3157-4014.

A template composition was prepared for standardizing the amplification efficiency of TCRG amplification primer sets. The composition comprised a plurality of template oligonucleotides having a plurality of oligonucleotide sequences of general formula (I). The TCRG template composition comprising 70 distinct template oligonucleotides is disclosed in the Sequence Listing in SEQ ID NOS:4015-4084.

A template composition was prepared for standardizing the amplification efficiency of IGH amplification primer sets. The composition comprised a plurality of template oligonucleotides having a plurality of oligonucleotide sequences of general formula (I). The IGH template composition comprising 1116 distinct template oligonucleotides is disclosed in the Sequence Listing in SEQ ID NOS:4085-5200. An IGH template composition comprising a set of 1116 template oligonucleotides is also disclosed in the Sequence Listing in SEQ TD NOS:1805-2920.

Example 5

Use of the Template Composition to Determine Amplification Factor

This example describes quantification of rearranged DNA molecules encoding a plurality of IG molecules, using the presently described template oligonucleotide composition as a "spiked-in" synthetic template in a multiplexed PCR amplification of a DNA sample containing B cell and fibroblast DNA.

Biological Template DNA: Eight biological samples were used as sources of template DNA, with each biological sample containing the same amount of total genomic DNA (gDNA), 300 ng, but in a different proportion of (i) DNA extracted from B cells to (ii) DNA extracted from human fibroblast cells, a cell type in which IG and TCR encoding genes do not rearrange. The samples contained 0, 0.07, 0.3, 1, 4, 18, 75 or 300 ng B cell gDNA, with fibroblast gDNA supplying the balance of each 300 ng gDNA preparation. Four replicates of each sample were made.

Synthetic Template DNA: To each PCR reaction (below) were added 5000 molecules (4-5 molecules of each sequence) from an oligonucleotide template composition comprising a pool of 1116 synthetic IGH template oligonucleotide molecules (SEQ ID NOS:4085-5200). An IGH template composition comprising a set of 1116 template oligonucleotides is also disclosed in the Sequence Listing as SEQ ID NOS:1805-2920.

PCR Reaction: The PCR reaction used QIAGEN Multiplex Plus™ PCR master mix (QIAGEN part number 206152, Qiagen, Valencia, Calif.), 10% Q-solution (QIAGEN), and 300 ng of biological template DNA (described above). The pooled amplification primers were added so the final reaction had an aggregate forward primer concentration of 2 µM and an aggregate reverse primer concentration of 2 µM. The forward primers (SEQ ID NOS:5201-5286) included 86 primers that had at the 3' end an approximately 20 bp segment that annealed to the IGH V segment encoding sequence and at the 5' end an approximately 20 bp universal primer pGEXf. The reverse primers (SEQ ID NOS:5287-5293) included an aggregate of J segment specific primers that at the 3' end had an approximately 20 bp segment that annealed to the IGH J segment encoding sequence and at the 5' end of the J primers was a universal primer pGEXr. The following thermal cycling conditions were used in a C100 thermal cycler (Bio-Rad Laboratories, Hercules, Calif., USA): one cycle at 95° C. for 10 minutes, 30 cycles at 94° C. for 30 seconds, 63° C. for 30 seconds, and 72° C. for one minute, followed by one cycle at 72° C. for 10 minutes. Each reaction was run in quadruplicates.

For sequencing, Illumina adapters (Illumina Inc., San Diego, Calif.), which also included a 8 bp tag and a 6 bp random set of nucleotides, were incorporated onto the ends of the PCR reaction products in a 7 cycle PCR reaction. The PCR reagents and conditions were as described above, except for the thermocycle conditions, which were: 95° C. for 5 minutes, followed by 7 cycles of 95° for 30 sec, 68° for 90 sec, and 72° for 30 sec. Following thermal cycling, the reactions were held for 10 minutes at 72° and the primers were the Illumina adaptor tailing primers (SEQ ID NOS:5387-5578). Samples were sequenced on an Illumina MiSEQ™ sequencer using the Illumina PE RD2 primer.

Results: Sequence data were obtained for each sample and amplification products of synthetic templates were identified by the presence of the barcode oligonucleotide sequence. For each sample, the number of template products was divided by the number of unique synthetic template oligonucleotide sequences (1116) to arrive at a sample amplification factor. The total number of amplification products of the biological templates for each sample was then divided by the amplification factor to calculate the number of rearranged biological template molecules (e.g., VDJ recombinations) in the starting amplification reaction as an estimate of the number of unique B cell genome templates. The average values with standard deviations were plotted against the known number of rearranged biological template molecules based on B cell input (FIG. 9). In FIG. 9, the dots represent the average amplification factor and the bars represent the standard deviation across the four replicates. The use of amplification factors calculated as described herein to estimate the number of VJ-rearranged IG encoding molecules (as a proxy value for the number of B cells) yielded determinations that were consistent with known B cell numbers at least down to an input of 100 B cells. The estimated amplification factor values and the observed amplification factor were highly correlated (FIG. 9, $R^2=0.9988$).

Example 6

IgH, IgL, and IgK BIAS CONTROL TEMPLATES

IgH VJ Template Oligonucleotides

In one embodiment, IgH VJ template oligonucleotides were generated and analyzed. A set of 1134 template oligonucleotides of general formula (I) was designed using human IgH V and J polynucleotide sequences. Each template oligonucleotide consisted of a 495 base pair DNA molecule. Details for the 1134-oligonucleotide set of IgH templates are representative and were as follows.

Based on previously determined genomic sequences, the human IgH locus was shown to contain 126 Vh segments that each had a RSS sequence and were therefore regarded as rearrangement-competent. These 126 Vh segments included 52 gene segments known to be expressed, five V segments that were classified as having open reading frames, and 69 V pseudogenes. The Vh gene segments were linked to 9 Jh gene segments. In order to include all possible V+J gene combinations for the 126 V and 9 J segments, 1134 (9×126) templates were designed that represented all possible VJ combinations. Each template conformed to the general formula (I) (5'-U1-B1-V-B2-R-J-B4-U2-3')(FIG. 1) and thus included nine sections, a 19 base pair (bp) universal adapter (U1), a 16 bp nucleotide tag uniquely identifying each paired combination of V gene and J gene segments (B1), 300 bp of V gene specific sequence (V), a 3 bp stop codon (S), another copy of the 16 bp nucleotide tag (B2), a 6 bp junction tag shared by all molecules (R), nothing for B3, 100 bp of J gene specific sequence (J), a third copy of the 16 bp nucleotide tag (B4), and a 19 bp universal adapter sequence (U2). Two V segments were nucleotide identical to another two V segments—and thus were not ordered. This reduced the number of included segments from 1134 to 1116. The IGH template composition comprising 1116 distinct template oligonucleotides is disclosed in the Sequence Listing in SEQ ID NOS:4085-5200.

Each of the 1116 templates was amplified individually using oligonucleotide primers designed to anneal to the universal adapter sequences (U1, U2). These oligonucleotide sequences can be any universal primer. For this application a universal primer coded Nextera was used.

TABLE 8

Universal Primer sequences included in bias control templates

| Primer Name | Primer Sequence | SEQ ID NO |
|---|---|---|
| pGEXF | GGGCTGGCAAGCCACGTTTGGTG | SEQ ID NO: 6428 |
| pGEXR | CCGGGAGCTGCATGTGTCAGAGG | SEQ ID NO: 6429 |

The universal primer sequences can be annealed to any primer sequence disclosed herein. An example of the PCR primers including the universal primer sequence are shown below:

TABLE 9

Example IGH PCR primers with Universal
Sequences (Bold and Underlined)

| Primer Name | Primer Sequence | SEQ ID NO |
|---|---|---|
| pGEXf_IGHV(II)-15-1_ver10_01 | GGGCTGGCAAGCCACGTTTGGTGAGCCCCCAGGGAAGAAGCTGAAGTGG | SEQ ID NO: 6430 |
| pGEXr_IGHJ1/4/5_ver10_03 | CCGGGAGCTGCATGTGTCAGAGGCACCTGAGGAGACGGTGACCAGGGT | SEQ ID NO: 6431 |

The resulting concentration of each amplified template oligonucleotide product was quantified using a LabChip GX™ capillary electrophoresis system (Caliper Life Sciences, Inc., Hopkinton, Mass.) according to the manufacturer's instructions. The 1116 amplified template oligonucleotide preparations were normalized to a standard concentration and then pooled.

To verify that all 1116 template oligonucleotides were present at substantially equimolar concentrations, the pool was sequenced using the Illumina MiSeq™ sequencing platform according to the manufacturer's recommendations. To incorporate platform-specific oligonucleotide sequences into the pooled template oligonucleotides, tailed primers were designed that annealed to the universal priming sites (U1, U2) and that had Illumina™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 1116 distinct template oligonucleotides was calculated to contain approximately ~0.09% of each member of the set, and a threshold tolerance of plus or minus ten-fold frequency (0.009%-0.9%) for all species was desired. The quantitative sequencing revealed that the 1116 species of adapter-modified template oligonucleotides within the initial pool were not evenly represented.

Accordingly, adjustment of the concentrations of individual template oligonucleotides and reiteration of the quantitative sequencing steps are conducted until each molecule is present within the threshold tolerance concentration (0.009-0.9%).

IgH DJ Template Oligonucleotides

In another embodiment, IgH DJ template oligonucleotides were generated and analyzed. A set of 243 template oligonucleotides of general formula (I) was designed using human IgH D and J polynucleotide sequences. Each template oligonucleotide consisted of a 382 base pair DNA molecule. The IgH DJ template oligonucleotide sequences are presented in SEQ ID NOs: 5579-5821. Details for the 243-oligonucleotide set of IgH templates are representative and were as follows.

Based on previously determined genomic sequences, the human IgH locus was shown to contain 27 Dh segments. The 27 Dh gene segments were linked to 9 Jh gene segments. To include all possible D+J gene combinations for the 27 D and 9 J segments, 243 (9×27) templates were designed that represented all possible DJ combinations. Each template conformed to the general formula (I) (5'-U1-B1-V-B2-R-J-B4-U2-3') (FIG. 1) and thus included nine sections, a 19 base pair (bp) universal adapter (U1), a 16 bp nucleotide tag uniquely identifying each paired combination of D gene and J gene segments (B1). However, for these molecules, the 300 bp of V gene specific sequence (V) was replaced with a segment of 182 bp of D gene specific sequence. This segment included both exonic and intronic nucleotide segments. Like the other molecules, these included a 3 base pair (bp) stop codon (S), another copy of the 16 bp nucleotide tag (B2), a 6 bp junction tag shared by all molecules (R), nothing for B3, 100 bp of J gene specific sequence (J), a third copy of the 16 bp nucleotide tag (B4), and a 19 bp universal adapter sequence (U2).

Each of the 243 templates (SEQ ID NOs: 5579-5821) was amplified individually using oligonucleotide primers designed to anneal to the universal adapter sequences (U1, U2; See Table 8). These oligonucleotide sequences can be any universal primer; for this application a universal primer coded Nextera was used.

An example of the PCR primers with the universal adapter sequences are shown in Table 10.

TABLE 10

Example IgH DJ PCR primers with Universal
Sequences (Bold and Underlined)

| Primer Name | Primer Sequence | SEQ ID NO |
|---|---|---|
| pGEXf_IGHV(II)-15-1_ver10_01 | GGGCTGGCAAGCCACGTTTGGTGAGCCCCCAGGGAAGAAGCTGAAGTGG | SEQ ID NO: 6432 |
| pGEXr_IGHJ1/4/5_ver10_03 | CCGGGAGCTGCATGTGTCAGAGGCACCTGAGGAGACGGTGACCAGGGT | SEQ ID NO: 6433 |

The resulting concentration of each amplified template oligonucleotide product was quantified using a LabChip GX™ capillary electrophoresis system (Caliper Life Sciences, Inc., Hopkinton, Mass.) according to the manufacturer's instructions. The 243 amplified template oligonucleotide preparations were normalized to a standard concentration and then pooled.

To verify that all 243 template oligonucleotides were present at substantially equimolar concentrations, the pool was sequenced using the Illumina MiSeq™ sequencing platform according to the manufacturer's recommendations. To incorporate platform-specific oligonucleotide sequences into the pooled template oligonucleotides, tailed primers were designed that annealed to the universal priming sites (U1, U2) and that had Illumina™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 243 distinct template oligonucleotides was calculated to contain approximately ~0.4% of each member of the set, and a threshold tolerance of plus or minus ten-fold frequency (0.04%-4.0%) for all species was desired. The quantitative sequencing revealed that the 243 species of adapter-modified template oligonucleotides within the initial pool were not evenly represented.

Accordingly, adjustment of the concentrations of individual template oligonucleotides and reiteration of the quantitative sequencing steps are conducted until each molecule is present within the threshold tolerance concentration (0.04-4.0%). Following normalization, this set was combined with 1116 IgH VJ bias control set for a pool of 1359 templates.

Figure 10:
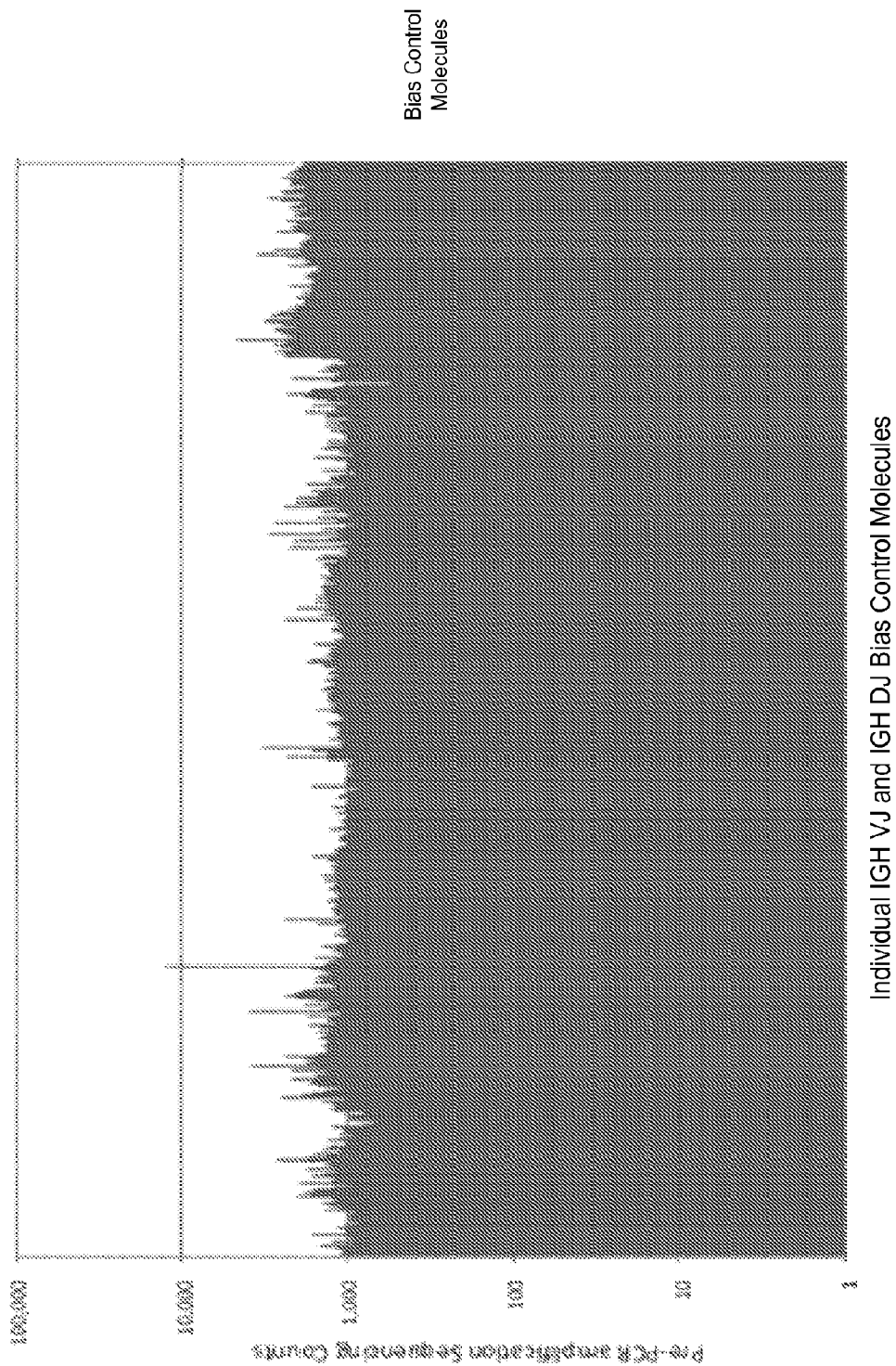
FIG. 10 shows a pre-PCR amplification sequencing count for each of 1116 IGH VJ bias control molecules and 243 IGH DJ bias control molecules.

FIG. 10 shows results for a pre-PCR amplification sequencing count for each of the 1116 IGH VJ bias control molecules and 243 IGH DJ bias control molecules. Individual bias control molecules are along the x-axis. The set includes the 1116 IGH VJ bias control molecules and 243 IGH DJ bias control molecules for a total of 1359 gblocks. The Y axis is the sequence count for each individual gblock. This calculation provides the quantification of the composition of the pre-amplification representation of each VJ pair. This data is used to estimate the change in frequency between the pre-sample and post-PCR amplification sample to calculate the amplification bias introduced by the primers.

IgL VJ Template Oligonucleotides

In another embodiment, IgL VJ template oligonucleotides were generated and analyzed. A set of 245 template oligonucleotides of general formula (I) was designed using human IgL V and J polynucleotide sequences. Each template oligonucleotide consisted of a 495 base pair DNA molecule. The IgL template oligonucleotides are presented as SEQ ID NOs: 5822-6066. Details for the 245-oligonucleotide set of IgL templates are representative and were as follows.

Based on previously determined genomic sequences, the human IgL locus was shown to contain 75 VL segments that each had a RSS sequence and were therefore regarded as rearrangement-competent. These 33 VL segments included gene segments known to be expressed, 5 V segments that were classified as having open reading frames, and 37 V pseudogenes. The VL gene segments were linked to five 6 JL gene segments. To include all possible functional and expressed V+J gene combinations for the 33 functional V and 6 J segments, 204 (6×33) templates were designed that represented all possible expressed VJ combinations. In addition, two of the V pseudogenes were questionable; an additional 12 (2×6) VJ templates were designed, resulting in a total of 216. Each template conformed to the general formula (I) (5'-U1-B1-V-B2-R-J-B4-U2-3') (FIG. 1) and thus included nine sections, a 19 base pair (bp) universal adapter (U1), a 16 bp nucleotide tag uniquely identifying each paired combination of V gene and J gene segments (B1), 300 bp of V gene specific sequence (V), a 3 bp stop codon (S), another copy of the 16 bp nucleotide tag (B2), a 6 bp junction tag shared by all molecules (R), nothing for B3, 100 bp of J gene specific sequence (J), a third copy of the 16 bp nucleotide tag (B4), and a 19 bp universal adapter sequence (U2).

Each of the 216 templates was amplified individually using oligonucleotide primers designed to anneal to the universal adapter sequences (U1, U2). These oligonucleotide sequences can be any universal primer; for this application, a universal primer coded Nextera was used.

The resulting concentration of each amplified template oligonucleotide product was quantified using a LabChip GX™ capillary electrophoresis system (Caliper Life Sciences, Inc., Hopkinton, Mass.) according to the manufacturer's instructions. The 216 amplified template oligonucleotide preparations were normalized to a standard concentration and then pooled.

To verify that all 216 template oligonucleotides were present at substantially equimolar concentrations, the pool was sequenced using the Illumina MiSeq™ sequencing platform according to the manufacturer's recommendations. To incorporate platform-specific oligonucleotide sequences into the pooled template oligonucleotides, tailed primers were designed that annealed to the universal priming sites (U1, U2) and that had Illumina™ adapter sequence tails as the 5' ends.

A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 216 distinct template oligonucleotides was calculated to contain approximately ~0.46% of each member of the set, and a threshold tolerance of plus or minus ten-fold frequency (0.046%-4.6%) for all species was desired. The quantitative sequencing revealed that the 216 species of adapter-modified template oligonucleotides within the initial pool evenly represented.

IgK VJ Template Oligonucleotides

In one embodiment, IgK VJ template oligonucleotides were generated and analyzed. A set of 560 template oligonucleotides of general formula (I) was designed using human IgK V and J polynucleotide sequences. Each template oligonucleotide consisted of a 495 base pair DNA molecule. Examples of IgK template oligonucleotides are found at SEQ ID NOs: 6067-6191. Details for the 560-oligonucleotide set of IgK templates are representative and were as follows.

Based on previously determined genomic sequences, the human IgK locus was shown to contain 112 Vk segments that each had a RSS sequence and were therefore regarded as rearrangement-competent. These 112 Vk segments included 46 gene segments known to be expressed, 8 V segments that were classified as having open reading frames, and 50 V pseudogenes. For this IgK, only expressed IgK VJ rearrangements were analyzed. Genes classified as pseudogenes and open reading frames were excluded. The Vk gene segments were linked to five Jk gene segments. This left us with 230 VJ gene rearrangements (46×5). To include all possible functional V+J gene combinations for the 46 functional V and 5 J segments, 230 (5×46) templates were designed that represented all possible VJ combinations. Each template conformed to the general formula (I) (5'-U1-B1-V-B2-R-J-B4-U2-3') (FIG. 1) and thus included nine sections, a 19 base pair (bp) universal adapter (U1), a 16 bp nucleotide tag uniquely identifying each paired combination of V gene and J gene segments (B1), 300 bp of V gene specific sequence (V), a 3 bp stop codon (S), another copy of the 16 bp nucleotide tag (B2), a 6 bp junction tag shared by all molecules (R), nothing for B3, 100 bp of J gene specific sequence (J), a third copy of the 16 bp nucleotide tag (B4), and a 19 bp universal adapter sequence (U2).

Each of the 230 templates was amplified individually using oligonucleotide primers designed to anneal to the universal adapter sequences (U1, U2). These oligonucleotide sequences can be any universal primer—for this application a universal primer coded Nextera was used.

The resulting concentration of each amplified template oligonucleotide product was quantified using a LabChip GX™ capillary electrophoresis system (Caliper Life Sciences, Inc., Hopkinton, Mass.) according to the manufacturer's instructions. The 230 amplified template oligonucleotide preparations were normalized to a standard concentration and then pooled.

To verify that all 230 template oligonucleotides were present at substantially equimolar concentrations, the pool was sequenced using the Illumina MiSeq™ sequencing platform according to the manufacturer's recommendations. Briefly, to incorporate platform-specific oligonucleotide sequences into the pooled template oligonucleotides, tailed primers were designed that annealed to the universal priming sites (U1, U2) and that had Illumina™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 230 distinct template oligonucleotides was calculated to contain approximately ~0.4% of each member of the set, and a threshold tolerance of plus or minus ten-fold frequency (4.0%-0.04%) for all species was desired. The quantitative sequencing revealed that the 230 species of adapter-modified template oligonucleotides within the initial pool were evenly represented.

Example 7

Combined Assays

IgH DJ and IgH VJ Combined Assay

In some embodiments, it is desired to co-amplify and sequence rearranged IgH VDJ CDR3 chains and rearranged IgH DJ chains. To generate a pool of templates to test a combined IgH DJ and IgH VJ assay using the IgH DJ and IgH VJ templates. When pooled-, the final pool includes 1116 VJ and 243 DJ templates, resulting in a total of 1359 individual templates. The IgH VJ template composition comprising 1116 distinct template oligonucleotides is disclosed in the Sequence Listing in SEQ ID NOs: 4085-5200. The IgH DJ template oligonucleotide sequences are presented in SEQ ID NOs: 5579-5821.

To verify that all 1359 template oligonucleotides were present at substantially equimolar concentrations, the pool was sequenced using the Illumina MiSeg™ sequencing platform according to the manufacturer's recommendations. To incorporate platform-specific oligonucleotide sequences into the pooled template oligonucleotides, tailed primers were designed that annealed to the universal priming sites (U1, U2) and that had Illumina™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 1359 distinct template oligonucleotides was calculated to contain approximately ~0.073% of each member of the set, and a threshold tolerance of plus or minus ten-fold frequency (0.73%-0.0073%) for all species was desired. The quantitative sequencing revealed that the 1359 species of adapter-modified template oligonucleotides within the initial pool were evenly represented.

IgL and IgK Combined Assay

In other embodiments, it is desired to co-amplify and sequence rearranged IgL and IgK rearranged CDR3 chains. To generate a pool of templates to test a combined IgL and IgK assay (the IgL and IgK templates were combined). When pooled, the final pool includes 216 IgL and 230 IgK templates, for a total of 446 individual templates. The IgL template oligonucleotides are presented as SEQ ID NOs: 5822-6066.

To verify that all 446 template oligonucleotides were present at substantially equimolar concentrations, the pool was sequenced using the Illumina MiSeg™ sequencing platform according to the manufacturer's recommendations. Briefly, to incorporate platform-specific oligonucleotide sequences into the pooled template oligonucleotides, tailed primers were designed that annealed to the universal priming sites (U1, U2) and that had Illumina™ adapter sequence tails as the 5' ends. A seven-cycle PCR reaction was then performed to anneal the Illumina adapters to the template oligonucleotides. The PCR reaction product mixture was then purified using Agencourt® AMPure® XP beads (Beckman Coulter, Inc., Fullerton, Calif.) under the conditions recommended by the manufacturer. The first 29 bp of the PCR reaction products were sequenced using an Illumina MiSEQ™ sequencer (Illumina, Inc., San Diego, Calif.) and analyzed by assessing the frequency of each 16 bp molecular barcode tag (B1).

A substantially equimolar preparation for the set of 446 distinct template oligonucleotides was calculated to contain approximately ~0.22% of each member of the set, and a threshold tolerance of plus or minus ten-fold frequency (2.2%-0.022%) for all species was desired. The quantitative sequencing revealed that the 446 species of adapter-modified template oligonucleotides within the initial pool were evenly represented.

Example 8

Correcting Non-Uniform Amplification Potential (PCR Bias) in IGH-Amplifying Oligonucleotide Primer Sets Diverse IgH amplification primers were designed to amplify every possible combination of rearranged IgH V and J gene segments in a biological sample that contains lymphoid cell DNA from a subject. A preparation containing equimolar concentrations of the diverse amplification primers was used in multiplexed PCR to amplify a diverse template composition that comprises equimolar concentrations of IgH-specific template oligonucleotides according to formula (I) with at least one template representing every possible V–J combination for the IgH locus. The amplification products were quantitatively sequenced and the frequency of occurrence of each unique V–J product sequence was obtained from the frequency of occurrence of each 16 bp molecular barcode sequence (B in formula (I)) that uniquely identified each V–J combination.

The multiplex PCR reaction was designed to amplify all possible V and J gene rearrangements of the IgH locus, as annotated by the IMGT collaboration. See Yousfi Monod M, Giudicelli V, Chaume D, Lefranc. MP. IMGT/JunctionAnalysis: the first tool for the analysis of the immunoglobulin and T cell receptor complex V–J and V-D-J JUNCTIONs. Bioinformatics. 2004; 20(suppl 1):i379-i385. The locus included 126 unique V genes; 52 functional genes, 6 putative open reading frames lacking critical amino acids for function and 69 pseudogenes; and 9 J genes, 6 functional and 3 pseudogenes. The target sequence for primer annealing was identical for some V segments, allowing amplification of all 126 V segments with 86 unique forward primers. Similarly, 7 unique reverse primers annealed to all 9 J genes. As a baseline for bias assessment, the pool of 1116 templates was amplified using an equimolar pool of the 86 V forward primers (VF; specific to V genes) and an equimolar pool of the 7 J reverse primers (JR; specific to J genes).

Polymerase chain reactions (PCR) (25 µL each) were set up at 2.0 µM VF, 2.0 µM JR pool (Integrated DNA Technologies), 1 µM QIAGEN Multiplex Plus PCR master mix (QIAGEN, Valencia, Calif.), 10% Q-solution (QIAGEN), and 200,000 target molecules from our synthetic IgH repertoire mix. The following thermal cycling conditions were used in a C100 thermal cycler (Bio-Rad Laboratories, Hercules, Calif.): one cycle at 95° C. for 6 minutes, 31 cycles at 95° C. for 30 see, 64° C. for 120 sec, and 72° C. for 90 sec, followed by one cycle at 72° C. for 3 minutes. For all experiments, each PCR condition was replicated three times.

Following initial bias assessment, experiments were performed to define all individual primer amplification characteristics. To determine the specificity of VF and JR primers, 86 mixtures were prepared containing a single VF primer with all JR primers, and 7 mixtures containing a single JR primer with all VF primers. These primer sets were used to amplify the synthetic template and sequenced the resulting libraries to measure the specificity of each primer for the targeted V or J gene segments, and to identify instances of off-target priming. Titration experiments were performed using pools of 2-fold and 4-fold concentrations of each individual VF or JF within the context of all other equimolar primers (e.g. 2×-fold IgHV1-01+ all other equimolar VF and JR primers) to estimate scaling factors relating primer concentration to observed template frequency.

Primer Mix Optimization

Using the scaling factors derived by titrating primers one at a time, alternative primer mixes were developed in which the primers were combined at uneven concentrations to minimize amplification bias. The revised primer mixes were then used to amplify the template pool and measure the residual amplification bias. This process was reiterated, reducing or increasing each primer concentration appropriately based on whether templates amplified by that primer were over or under-represented in the previous round of results. At each stage of this iterative process, the overall degree of amplification bias was determined by calculating metrics for the dynamic range (max bias/min bias) and sum of squares (SS, calculated on log(bias) values), and iterated the process of adjusting primer concentrations until there was minimal improvement between iterations. To assess the robustness of the final optimized primer mix and scaling factors to deviations from equimolar template input, we used a highly uneven mixture of IgH reference templates to determine the effect on sequencing output. The final mix was substantially better than an equimolar mix.

Example 9

Correcting Non-Uniform Amplification Potential (PCR Bias) in TCRB-Amplifying Oligonucleotide Primer Sets Diverse TCRB amplification primers were designed to amplify every possible combination of rearranged TCRB V and J gene segments in a biological sample that contains lymphoid cell DNA from a subject. A preparation containing equimolar concentrations of the diverse amplification primers was used in multiplexed PCR to amplify a diverse template composition that comprises equimolar concentrations of TCRB-specific template oligonucleotides according to formula (I) with at least one template representing every possible V-J combination for the TCRB locus. The amplification products were quantitatively sequenced and the frequency of occurrence of each unique V-J product sequence was obtained from the frequency of occurrence of each 16 bp molecular barcode sequence (B in formula (I)) that uniquely identifies each V-J combination.

The multiplex PCR reaction was designed to amplify all possible V and J gene rearrangements of the TCRB locus, as annotated by the IMGT collaboration. See Yousfi Monod M, Giudicelli V, Chaume D, Lefranc. MP. IMGT/JunctionAnalysis: the first tool for the analysis of the immunoglobulin and T cell receptor complex V-J and V-D-J JUNCTIONs. Bioinformatics. 2004; 20(suppl 1):i379-i385. The locus includes 67 unique V genes. The target sequence for primer annealing was identical for some V segments, allowing us to amplify all 67 V segments with 60 unique forward primers. For the J locus, 13 unique reverse primers annealed to 13 J genes. As a baseline for bias assessment, the pool of 868 templates was amplified using an equimolar pool of the 60 V forward primers (VF; specific to V genes) and an equimolar pool of the 13 J reverse primers (JR; specific to J genes). Polymerase chain reactions (PCR) (25 µL each) were set up at 3.0 µM VF, 3.0 µM JR pool (Integrated DNA Technologies), 1 µM QIAGEN Multiplex Plus PCR master mix (QIAGEN, Valencia, Calif.), 10% Q-solution (QIAGEN and 200,000 target molecules from our synthetic TCRB repertoire mix. The following thermal cycling conditions were used in a 0100 thermal cycler (Bio-Rad Laboratories, Hercules, Calif.): one cycle at 95° C.' for 5 minutes, 31 cycles at 95° C. for 30 sec 62° C. for 90 sec. and 72° C. for 90 sec, followed by one cycle at 72° C. for 3 minutes. For all experiments, each PCR condition was replicated three times.

Following initial bias assessment, experiments were performed to define all individual primer amplification characteristics. To determine the specificity of our VF and JR primers, 60 mixtures were prepared containing a single VF primer with all JR primers, and 13 mixtures containing a single JR primer with all VF primers. These primer sets were used to amplify the synthetic template and sequenced the resulting libraries to measure the specificity of each primer for the targeted V or J gene segments and to identify instances of off-target priming. Titration experiments were performed using pools of 2-fold and 4-fold concentrations of each individual VF or JF within the context of all other equimolar primers (e.g. 2×-fold TCRBV07-6+ all other equimolar VF and JR primers) to allow us to estimate scaling factors relating primer concentration to observed template frequency.

Primer Mix Optimization

Using the scaling factors derived by titrating primers one at a time, alternative primer mixes were developed in which the primers were combined at uneven concentrations to minimize amplification bias. The revised primer mixes were then used to amplify the template pool and measure the residual amplification bias. This process was iterated, reducing or increasing each primer concentration appropriately based on whether templates amplified by that primer were over or under-represented in the previous round of results. At each stage of this iterative process, the overall degree of amplification bias was determined by calculating metrics for the dynamic range (max bias/min bias) and sum of squares (SS, calculated on log(bias) values), and iterated the process of adjusting primer concentrations until there was minimal improvement between iterations. The final mix was substantially better than an equimolar mix of primers.

Figure 11:
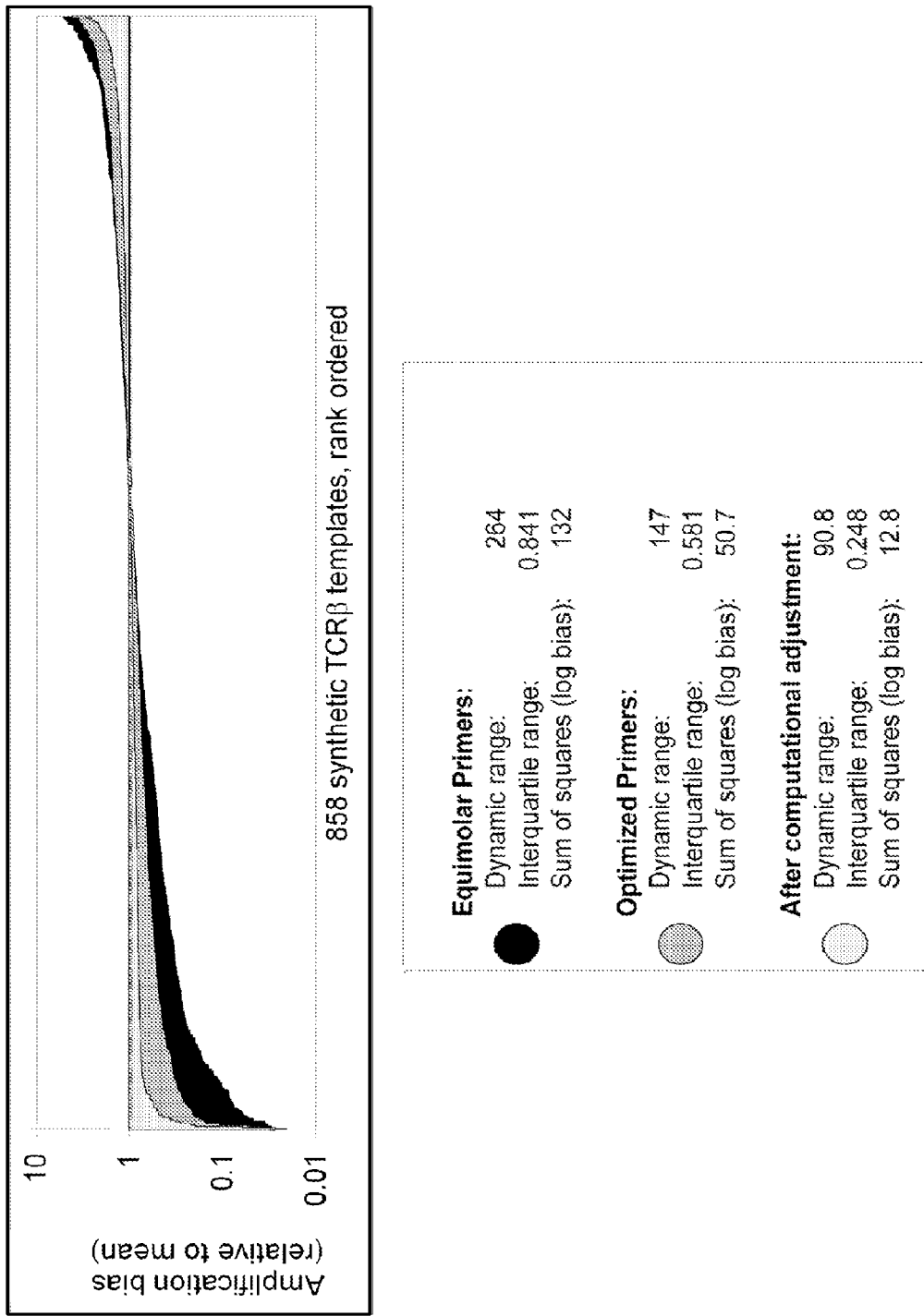
FIG. 11 shows TCRB-primer iterations for synthetic TCRB VJ templates graphed against relative amplification bias.

FIG. 11 shows TCRB-primer iterations for synthetic TCRB VJ templates graphed against relative amplification bias. Relative amplification bias was determined for 858 synthetic TCRB VJ templates prior to chemical bias control correction (Equimolar Primers (black)), post chemical correction (Optimized Primers (dark grey)), and post chemical and computational correction (After computational adjustment (light grey)). The equimolar primers had a dynamic range of 264, an interquartile range of 0.841, and a sum of squares (log bias) of 132. The optimized primers had a dynamic range of 147, an interquartile range of 0.581, and a sum of squares (log bias) of 50.7. The corrected primers (after computational adjustment) had a dynamic range of 90.8, an interquartile range of 0.248, and a sum of squares (log bias) of 12.8.

Example 10

Correcting Non-Uniform Amplification Potential (PCR Bias) in a Combined IGH VJ and DJ-Amplifying Oligonucleotide Primer Sets Diverse IgH amplification primers were designed to amplify every possible combination of rearranged IgH V and J gene segments and IgH D and J gene segments in a biological sample that contained lymphoid cell DNA from a subject. A preparation containing equimolar concentrations of the diverse amplification primers was used in multiplexed PCR to amplify a diverse template composition that comprises equimolar concentrations of IgH-specific template oligonucleotides according to formula (I) with at least one template representing every possible V-J combination for the IgH locus and every possible D-J combination for the IgH locus. The amplification products were quantitatively sequenced and the frequency of occurrence of each unique V-J and D-J product sequence was obtained from the frequency of occurrence of each 16 bp molecular barcode sequence (B in formula (I)) that uniquely identifies each V-J and D-J combination.

The multiplex PCR reaction was designed to amplify all possible V and J gene rearrangements AND D and J gene rearrangements of the IgH locus, as annotated by the IMGT collaboration. The locus included 126 unique V genes; 52 functional genes, 6 putative open reading frames lacking critical amino acids for function and 69 pseudogenes; and 9 J genes, 6 functional and 3 pseudogenes. The locus also included 27 unique D genes. The target sequence for primer annealing was identical for some V segments, allowing amplification of all 126 V segments with 86 unique forward primers. Similarly, 7 unique reverse primers annealed to all 9 J genes. For the D-J assay, primers were designed to anneal to rearranged –DJ stems. During B cell development, both alleles undergo rearrangement between the D and J gene segments, resulting in two –DJ stems. A –DJ stem includes a J gene, one N region, and a D gene. Following DJ rearrangements, one of the two alleles V gene rearranges with the –DJ stem to code for the CDR3 gene region (VnDnJ). To amplify the –DJ stem, 27 unique primers were designed to anneal to each specific D genes in an intronic region upstream of the D gene exon. These segments, while present in –DJ stems. are excised following V to –DJ recombination. However, J primers were not re-designed; the DJ assay used the same J primers as the VJ assay.

As a baseline for bias assessment, the pool of 1359 templates was amplified using an optimized (mix 2-1) pool of the 86 V forward primers (VF; specific to V genes), 27 D forward primers (DF; specific to D genes) and an equimolar pool of the 7 J reverse primers (JR; specific to J genes). Polymerase chain reactions (PCR) (25 μL each) were set up at 1.0 VF, 1.0 μM DF, and 2.0 μM JR pool (Integrated DNA Technologies), 1×QIAGEN Multiplex Plus PCR master mix (QIAGEN, Valencia, Calif.), 10% Q-solution (QIAGEN), and 200,000 target molecules from our synthetic IgH VJ and DJ repertoire mix. The following thermal cycling conditions were used in a C100 thermal cycler (Bio-Rad Laboratories, Hercules, Calif.): one cycle at 95° C. for 6 minutes, 31 cycles at 95° C. for 30 sec, 64° C. for 120 sec, and 72° C. for 90 sec, followed by one cycle at 72° C. for 3 minutes. For all experiments, each PCR condition was replicated three times.

Following initial bias assessment, experiments were performed to define all individual primer amplification characteristics. To determine the specificity of our DF and JR primers, 27 mixtures were prepared containing a single DF primer with all JR primers and the previously identified optimized VF pool, and 7 mixtures containing a single JR primer with all VF and DF primers. These primer sets were used to amplify the synthetic template and sequenced the resulting libraries to measure the specificity of each primer for the targeted V, D, or J gene segments, and to identify instances of off-target priming.

Titration experiments were performed using pools of 2-fold and 4-fold concentrations of each individual DF or JF within the context of all other primers—including the optimized mix of VF primers (e.g. 2×-fold IgHD2-08+ all other equimolar DF, optimal VF mix, and JR primers) to allow us to estimate scaling factors relating primer concentration to observed template frequency.

Primer Mix Optimization

Using the cross-amplification test, the DF primers were identified as cross amplified. 12 of the DF primers were removed, resulting in a final pool of 15 DF primers. Using the scaling factors derived by titrating primers one at a time, alternative primer mixes were developed in which the primers were combined at uneven concentrations to minimize amplification bias. The revised primer mixes were then used to amplify the template pool and measure the residual amplification bias. This process was iterated, reducing or increasing each primer concentration appropriately based on whether templates amplified by that primer were over or under-represented in the previous round of results. At each stage of this iterative process, the overall degree of amplification bias was determined by calculating metrics for the dynamic range (max bias/min bias) and sum of squares (SS, calculated on log(bias) values), and iterated the process of adjusting primer concentrations until there was minimal improvement between iterations. The final primer mix has substantially less primer bias than an equimolar primer mix.

Figure 12:
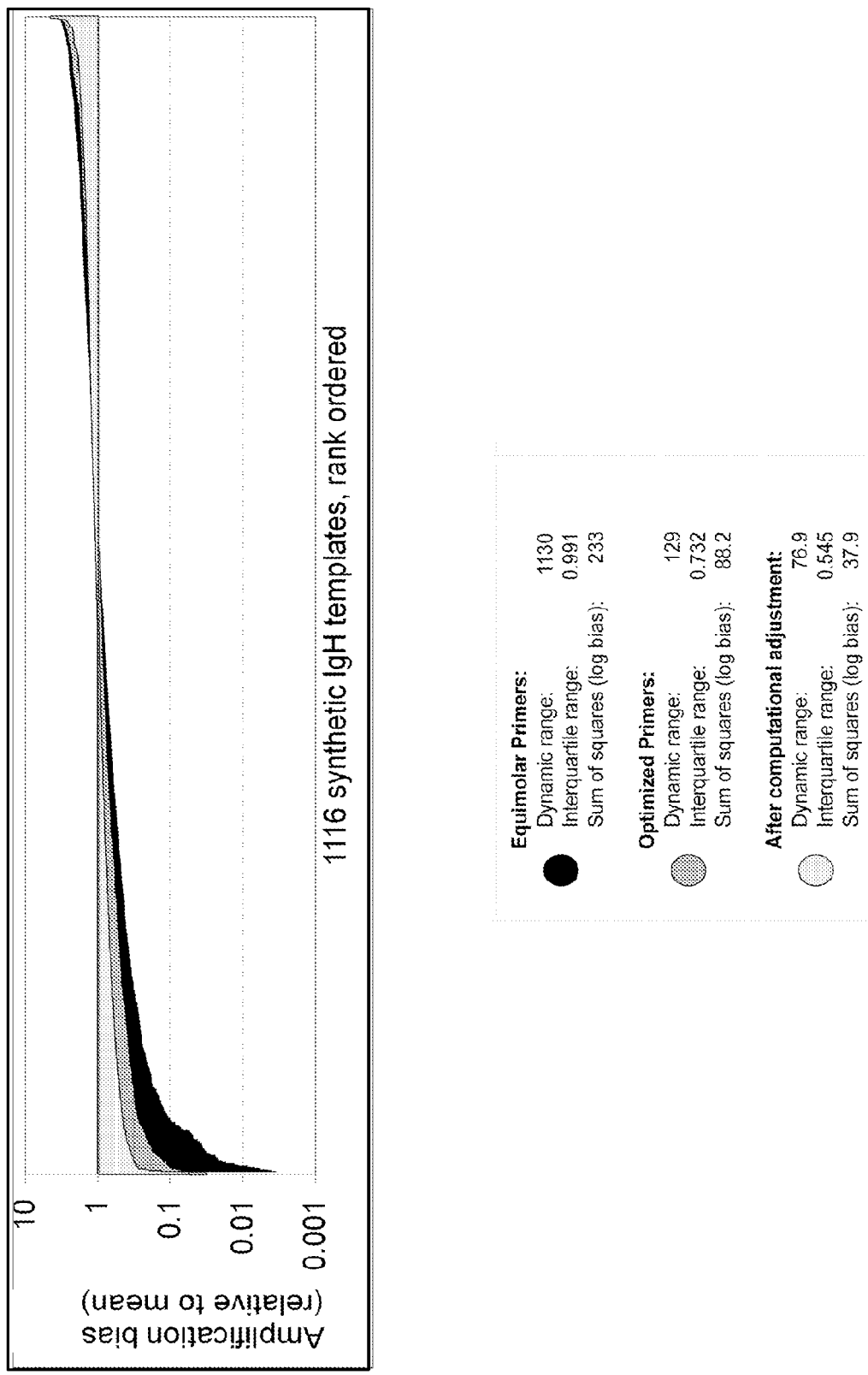
FIG. 12 shows IGH primer iterations for synthetic IGH VJ templates graphed against relative amplification bias.

FIG. 12 shows IGH primer iterations for synthetic IGH VJ templates graphed against relative amplification bias. Relative amplification bias was determined for 1116 synthetic IGH VJ templates relative amplification bias prior to chemical bias control correction (equimolar primers (black)), post chemical correction (optimized primers (dark grey)), and post chemical and computational correction (After computational adjustment (light grey)). The equimolar primers had a dynamic range of 1130, an interquartile range of 0.991, and a sum of squares (log bias) of 233. The optimized primers had a dynamic range of 129, an interquartile range of 0.732, and a sum of squares (log bias) of 88.2. The after computational adjusted primers had a dynamic range of 76.9, an interquartile range of 0.545, and a sum of squares (log bias) of 37.9.

Figure 13:
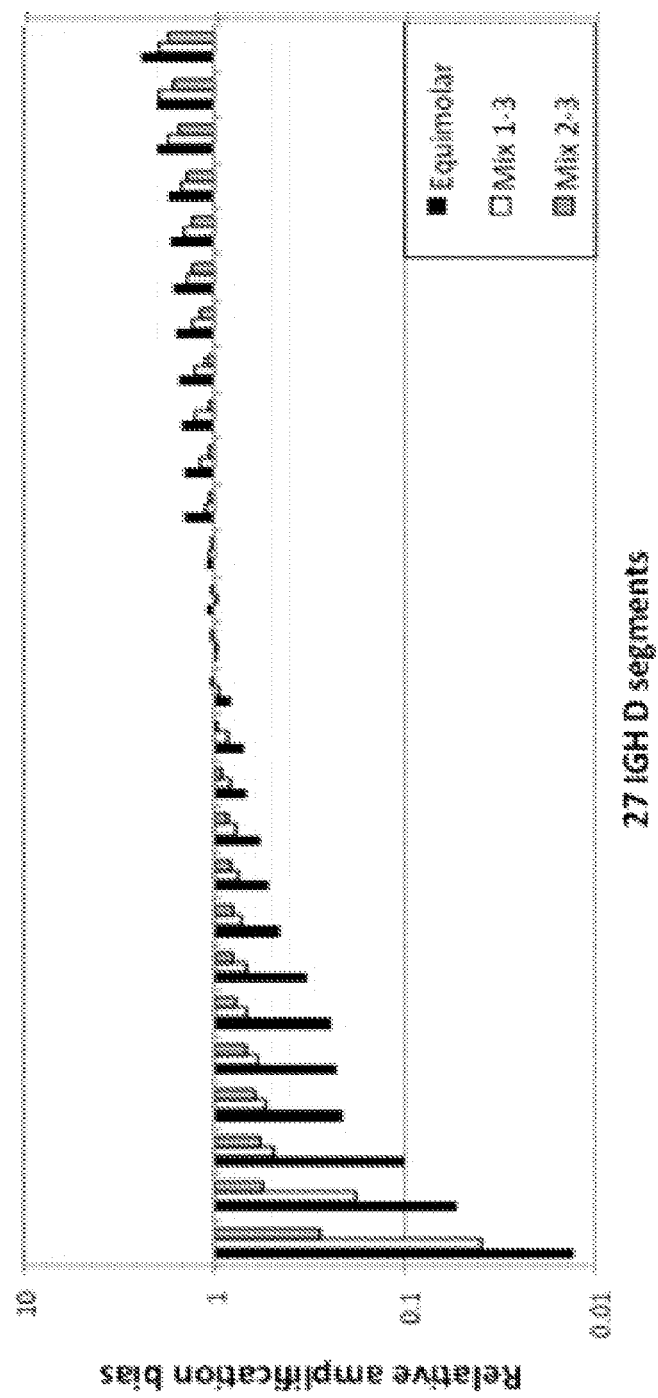
FIG. 13 shows the relative amplification bias for 27 synthetic IGH DJ templates of the V gene.

FIG. 13 shows the relative amplification bias for 27 synthetic IGH DJ templates of the V gene. Relative amplification bias of the V gene segment is shown in three primer iterations: 1) prior to chemical bias control correction (black), 2) a first iteration of chemical correction (white), and 3) a post second iteration of chemical correction (light grey).

Example 11

TCRG VJ Primer Iterations

Figure 14C:
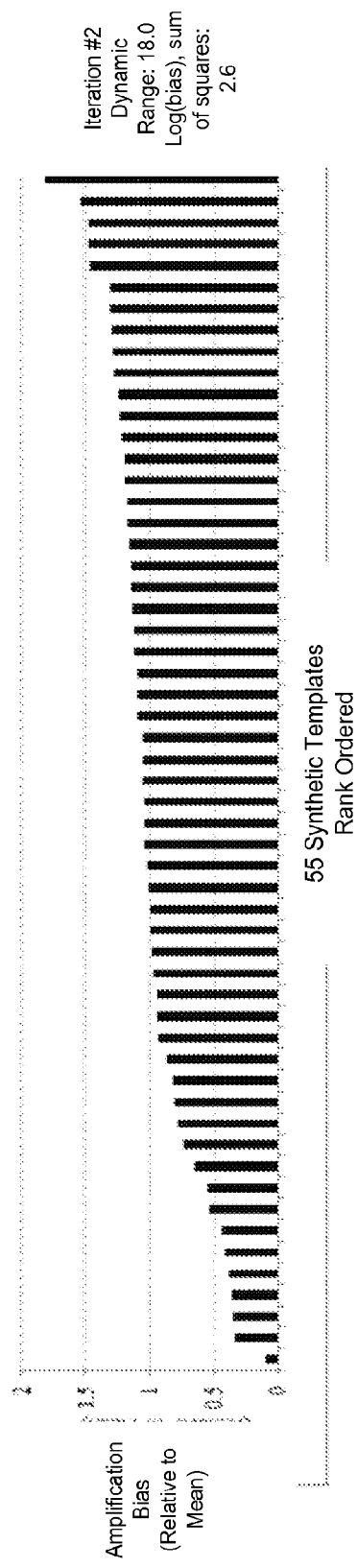
Figure 14D:
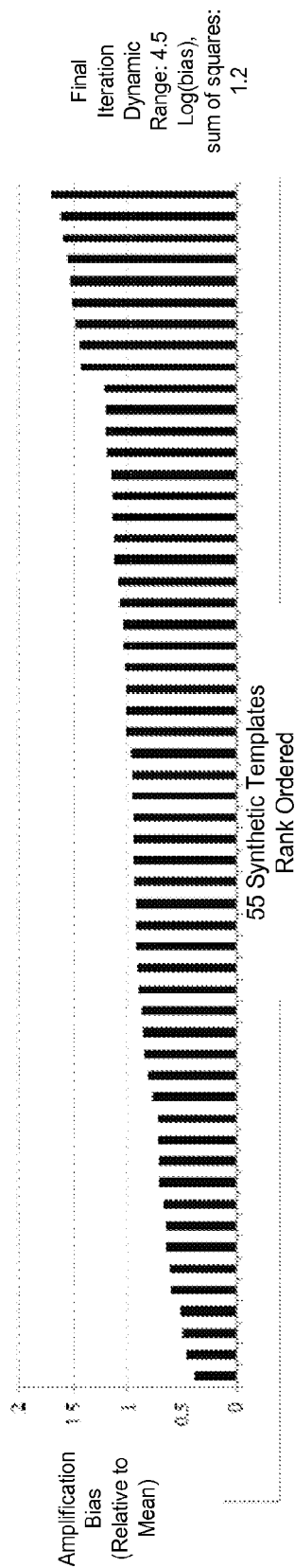

In other embodiments, TCRG VJ primers were tested for relative amplification bias in multiple primer iterations. FIGS. 14a-d show TCRG-primer iterations for 55 synthetic TCRG VJ templates. Relative amplification bias was determined for the TCRG VJ primers prior to chemical bias control correction (FIG. 14a), a first iteration of chemical correction (FIG. 14b), a second iteration of chemical correction (FIG. 14c), and final iteration of chemical correction (FIG. 14d).

Example 12

Alternative Bias Control and Spike-In Method

In other embodiments, alternative methods can be used to determine amplification bias. Two primary goals of the method are as follows: (1) to remove amplification bias in a multiplex PCR amplification of BCR or TCR genes and (2) to estimate the fraction of B or T cells in the starting template.

The method includes starting with a set of cells comprising DNA, or cDNA (mRNA) extracted from a sample that includes B and/or T cells. In a sample comprising cells, the DNA is extracted using methods standard in the art.

The extracted DNA is divided into multiple parts and put into different PCR wells. In some embodiments, one well is used to full capacity or thousands of wells can be used. In one embodiment, 188 wells are used for PCR (two 96 well plates). The number of TCR or BCR templates per well should be sparse, such that it is rare to have multiple molecules from the same clonotype in the same well.

The method then includes amplifying the DNA separately in each well using the same multiplex set of primers. The sets of primers described herein can be used. As described above, the bar coding method is applied to the amplified molecules in each well with the same barcode sequence. For example, each well gets its own barcode.

The molecules are then sequenced on a high throughput sequencing machine with a sufficient amount of the amplified BCR or TCR sequences to identify by sequence the V and the J chain used, as well as the bar code sequence.

Each well has an average copy count. Since each clonotype appears once in a well, the amount of that template relative to the average is the bias for that V-J combination. Since V and J bias are independent, not every V-J combination is necessary to determine the biases. These relative biases are then used to either re-design primers that are either highly under or over amplifying or to titrate the primer concentration to increase or decrease amplification. The entire process is repeated with a new primer lot and iterated to continue to decrease bias.

After any cycle of the iterations, a set of computational factors (the relative amplification factors) can be applied to remove bias. Bias can be reduced by both (or either) primer changes and computational correction.

The method includes computing a fraction of nucleated cells from a similar assay. For each well, each clonotype is identified, and the number of sequencing reads is determined for each clone. In some embodiments, the number of templates does not need to be sparse. The read counts for each clone are corrected by the bias control factors as described above.

A histogram is created of the corrected read counts, and the graph has a primary mode (the amplification factor). This mode is identified by inspection (based on identification of the first large peak), or by Fourier transform, or other known methods.

The total number of corrected reads in each well is divided by the amplification factor for that well. This is the estimated number of TCR or BCR genome templates that were in the well. The total number of BCR or TCRs from the sample is the sum of the number from all the wells. The total number of genomes in each well is measured prior to PCR. This can be done by nanodrop, or other known methods used to quantify DNA. The measured weight of the DNA is divided by the weight of a double stranded genome (for example, in humans ~6.2 pico grams).

The fraction of B cells or T cells in the sample is the total number of BCR or TCRs in the samples divided by the total number of double stranded DNA molecules added to the reaction. The result needs a minor correction as a small fraction of T cells have both alleles rearranged. This correction factor is approximately 15% for alpha beta T cells, 10% for B cells. For gamma delta T cells, almost all of the cells have both alleles rearranged, so the correction is a factor of two.

These additional methods can determine amplification bias in a multiplex PCR amplification of BCR or TCR genes and be used to estimate the fraction of B or T cells in the starting template.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

INFORMAL SEQUENCE LISTING

| Name | Sequence | SEQ ID NO |
|---|---|---|
| Bias Control Sequences for hs-IgH-DJ (243 Sequences) | | |
| hsIGH_2001_D001_J001_IGHD1-01_IGHJ1 | GCCTTGCCAGCCCGCTCAGGACACTCTGTACAGTGGCCCCGGTCTCTG TGGGTGTTCCGCTAACTGGGGCTCCCAGTGCTCACCCCACAACTAAAG CGAGCCCCAGCCTCCAGAGCCCCCGAAGGAGATGCCGCCCACAAGCCC AGCCCCCATCCAGGAGGCCCCAGAGCTCAGGGCGCCGGGGCAGATTCT GAACAGCCCCGAGTCACGGTGGGTACAACTGGAGACACTCTGTACAGT | SEQ ID NO: 5579 |

| INFORMAL SEQUENCE LISTING | | |
|---|---|---|
| | GGTCGACATACTTCCAGCACTGGGGCCAGGGCACCCTGGTCACCGTCT<br>CCTCAGGTGAGTCTGCTGTCTGGGGATAGCGGGGAGCCAGGTGTACTG<br>GGCCAGGCAAGGACACTCTGTACAGTGCTGATGGCGCGAGGGAGGC | |
| hsIGH_2002_D002_J001_IGHD1-<br>07_IGHJ1 | GCCTTGCCAGCCCGCTCAGTTCGGAACGTACAGTGGGCCTCGGTCTCT<br>GTGGGTGTTCCGCTAGCTGGGGCTCACAGTGCTCACCCCACACCTAAA<br>ACGAGCCACAGCCTCAGAGCCCCTGAAGGAGACCCCGCCCACAAGCCC<br>AGCCCCCACCCAGGAGGCCCCAGAGACACAGGGCGCCCCGTCGGATTCT<br>GAACAGCCCCGAGTCACAGTGGGTATAACTGGATTCGGAACGTACAGT<br>GGTCGACATACTTCCAGCACTGGGGCCAGGGCACCCTGGTCACCGTCT<br>CCTCAGGTGAGTCTGCTGTCTGGGGATAGCGGGGAGCCAGGTGTACTG<br>GGCCAGGCAAGTTCGGAACGTACAGTGCTGATGGCGCGAGGGAGGC | SEQ ID NO:<br>5580 |
| hsIGH_2003_D003_J001_IGHD1-<br>14_IGHJ1 | GCCTTGCCAGCCCGCTCAGAAGTAACGGTACAGTGGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGGTACAGT<br>GGTCGACATACTTCCAGCACTGGGGCCAGGGCACCCTGGTCACCGTCT<br>CCTCAGGTGAGTCTGCTGTCTGGGGATAGCGGGGAGCCAGGTGTACTG<br>GGCCAGGCAAGAAGTAACGGTACAGTGCTGATGGCGCGAGGGAGGC | SEQ ID NO:<br>5581 |
| hsIGH_2004_D004_J001_IGHD1-<br>20_IGHJ1 | GCCTTGCCAGCCCGCTCAGGTCTCCTAGTACAGTGGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTAGTACAGT<br>GGTCGACATACTTCCAGCACTGGGGCCAGGGCACCCTGGTCACCGTCT<br>CCTCAGGTGAGTCTGCTGTCTGGGGATAGCGGGGAGCCAGGTGTACTG<br>GGCCAGGCAAGGTCTCCTAGTACAGTGCTGATGGCGCGAGGGAGGC | SEQ ID NO:<br>5582 |
| hsIGH_2005_D005_J001_IGHD1-<br>26_IGHJ1 | GCCTTGCCAGCCCGCTCAGAGAGTGTCGTACAGTGAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCGTAC<br>AGTGGTCGACATACTTCCAGCACTGGGGCCAGGGCACCCTGGTCACCG<br>TCTCCTCAGGTGAGTCTGCTGTCTGGGGATAGCGGGGAGCCAGGTGTA<br>CTGGGCCAGGCAAGAGAGTGTCGTACAGTGCTGATGGCGCGAGGGAGG<br>C | SEQ ID NO:<br>5583 |
| hsIGH_2006_D006_J001_IGHD2-<br>02_IGHJ1 | GCCTTGCCAGCCCGCTCAGGTTCCGAAGTACAGTGAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAAGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGGTTCCGAAGTACAGTGCTGATGG<br>CGCGAGGGAGGC | SEQ ID NO:<br>5584 |
| hsIGH_2007_D007_J001_IGHD2-<br>08_IGHJ1 | GCCTTGCCAGCCCGCTCAGCGTTACTTGTACAGTGAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGCTCAGTGACACCCGCAGGGACAGGAGGATTTT<br>GTGGGGGCTCGTGTCACTGTGAGGATATTGTACTAATGGTGTATGCTC<br>GTTACTTGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGCGTTACTTGTACAGTGCTGATGG<br>CGCGAGGGAGGC | SEQ ID NO:<br>5585 |
| hsIGH_2008_D008_J001_IGHD2-<br>15_IGHJ1 | GCCTTGCCAGCCCGCTCAGTAGGAGACGTACAGTGAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGTAGGAGACGTACAGTGCTGATGG<br>CGCGAGGGAGGC | SEQ ID NO:<br>5586 |
| hsIGH_2009_D009_J001_IGHD2-<br>21_IGHJ1 | GCCTTGCCAGCCCGCTCAGGTGTCTACGTACAGTGAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCCTGTAGGGACAGGAGGATTTT<br>GTGGGGGTTCGTGTCACTGTGAGCATATTGTGGTGGTGACTGCTGTGT<br>CTACGTACAGTGGTCGACATACTTCCAGCACTGGGGCCAGGGCACCCT | SEQ ID NO:<br>5587 |

| | INFORMAL SEQUENCE LISTING | |
|---|---|---|
| | GGTCACCGTCTCCTCAGGTGAGTCTGCTGTCTGGGGATAGCGGGGAGC<br>CAGGTGTACTGGGCCAGGCAAGGTGTCTACGTACAGTGCTGATGGCGC<br>GAGGGAGGC | |
| hsIGH_2010_D010_J001_IGHD3-<br>03_IGHJ1 | GCCTTGCCAGCCCGCTCAGTGCTACACGTACAGTGGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGTGCTACACGTACAGTGCTGATGG<br>CGCGAGGGAGGC | SEQ ID NO:<br>5588 |
| hsIGH_2011_D011_J001_IGHD3-<br>09_IGHJ1 | GCCTTGCCAGCCCGCTCAGAACTGCCAGTACAGTGTGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCAGGTTTCCCCAGGCCTGCCGGTAGGTTTAG<br>AATGAGGTCTGTGTCACTGTGGTATTACGATATTTTGACTGGTTATTA<br>ACTGCCAGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGAACTGCCAGTACAGTGCTGATGG<br>CGCGAGGGAGGC | SEQ ID NO:<br>5589 |
| hsIGH_2012_D012_J001_IGHD3-<br>10_IGHJ1 | GCCTTGCCAGCCCGCTCAGTTGGACTGGTACAGTGCGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGTTGGACTGGTACAGTGCTGATGG<br>CGCGAGGGAGGC | SEQ ID NO:<br>5590 |
| hsIGH_2013_D013_J001_IGHD3-<br>16_IGHJ1 | GCCTTGCCAGCCCGCTCAGGTAGACACGTACAGTGTGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACGTACAGTGGTCGACATACTTCCAGCACTGGGGCCA<br>GGGCACCCTGGTCACCGTCTCCTCAGGTGAGTCTGCTGTCTGGGGATA<br>GCGGGGAGCCAGGTGTACTGGGCCAGGCAAGGTAGACACGTACAGTGC<br>TGATGGCGCGAGGGAGGC | SEQ ID NO:<br>5591 |
| hsIGH_2014_D014_J001_IGHD3-<br>22_IGHJ1 | GCCTTGCCAGCCCGCTCAGCACTGTACGTACAGTGTGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA<br>AGTGAGGTCTGTGTCACTGTGGTATTACTATGATAGTAGTGGTTATTC<br>ACTGTACGTACAGTGGTCGACATACTTCCAGCACTGGGGCCAGGGCAC<br>CCTGGTCACCGTCTCCTCAGGTGAGTCTGCTGTCTGGGGATAGCGGGG<br>AGCCAGGTGTACTGGGCCAGGCAAGCACTGTACGTACAGTGCTGATGG<br>CGCGAGGGAGGC | SEQ IDNO:<br>5592 |
| hsIGH_2015_D015_J001_IGHD4-<br>04_IGHJ1 | GCCTTGCCAGCCCGCTCAGGATGATCCGTACAGTGCAAGGGTGAGTCA<br>GACCCTCCTGCCCTCGATGGCAGGCGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCGTACAGTG<br>GTCGACATACTTCCAGCACTGGGGCCAGGGCACCCTGGTCACCGTCTC<br>CTCAGGTGAGTCTGCTGTCTGGGGATAGCGGGGAGCCAGGTGTACTGG<br>GCCAGGCAAGGATGATCCGTACAGTGCTGATGGCGCGAGGGAGGC | SEQ ID NO:<br>5593 |
| hsIGH_2016_D016_J001_IGHD4-<br>11_IGHJ1 | GCCTTGCCAGCCCGCTCAGCGCCAATAGTACAGTGTGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACAGTACGCCAATAGTACAGTG<br>GTCGACATACTTCCAGCACTGGGGCCAGGGCACCCTGGTCACCGTCTC<br>CTCAGGTGAGTCTGCTGTCTGGGGATAGCGGGGAGCCAGGTGTACTGG<br>GCCAGGCAAGCGCCAATAGTACAGTGCTGATGGCGCGAGGGAGGC | SEQ ID NO:<br>5594 |
| hsIGH_2017_D017_J001_IGHD4-<br>17_IGHJ1 | GCCTTGCCAGCCCGCTCAGTCAAGCCTGTACAGTGGGAGGGTGAGTCA<br>GACCCACCTGCCCTCGATGGCAGGCGGGAAGATTCAGAAAGGCCTGA<br>GATCCCCAGGACGCAGCACCACTGTCAATGGGGGCCCCAGACGCCTGG<br>ACCAGGGCCTGCGTGGGAAAGGCCGCTGGGCACACTCAGGGGCTTTTT<br>GTGAAGGCCCCTCCTACTGTGTGACTACGGTGTCAAGCCTGTACAGTG | SEQ ID NO:<br>5595 |

-continued

| INFORMAL SEQUENCE LISTING | | |
|---|---|---|
| | GTCGACATACTTCCAGCACTGGGGCCAGGGCACCCTGGTCACCGTCTC<br>CTCAGGTGAGTCTGCTGTCTGGGGATAGCGGGGAGCCAGGTGTACTGG<br>GCCAGGCAAGTCAAGCCTGTACAGTGCTGATGGCGCGAGGGAGGC | |
| hsIGH_2018_D018_J001_IGHD4-<br>23_IGHJ1 | GCCTTGCCAGCCCGCTCAGACGTGTGTGTACAGTGGGAGGGTGAGTCA<br>GACCCACCTGCCCTCAATGGCAGGCGGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTGTGTACA<br>GTGGTCGACATACTTCCAGCACTGGGGCCAGGGCACCCTGGTCACCGT<br>CTCCTCAGGTGAGTCTGCTGTCTGGGGATAGCGGGGAGCCAGGTGTAC<br>TGGGCCAGGCAAGACGTGTGTGTACAGTGCTGATGGCGCGAGGGAGGC | SEQ ID NO:<br>5596 |
| hsIGH_2019_D019_J001_IGHD5-<br>05_IGHJ1 | GCCTTGCCAGCCCGCTCAGTCCGTCTAGTACAGTGAGAGGCCTCTCCA<br>GGGGGACACTGTGCATGTCTGGTCCCTGAGCAGCCCCCCATGTCCCCA<br>GTCCTGGGGGGCCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTCCGTCTAGTAC<br>AGTGGTCGACATACTTCCAGCACTGGGGCCAGGGCACCCTGGTCACCG<br>TCTCCTCAGGTGAGTCTGCTGTCTGGGGATAGCGGGGAGCCAGGTGTA<br>CTGGGCCAGGCAAGTCCGTCTAGTACAGTGCTGATGGCGCGAGGGAGG<br>C | SEQ ID NO:<br>5597 |
| hsIGH_2020_D020_J001_IGHD5-<br>12_IGHJ1 | GCCTTGCCAGCCCGCTCAGAAGAGCTGGTACAGTGGCAGAGGCCTCTC<br>CAGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATATAGTGGCTACGAAGAGCTGG<br>TACAGTGGTCGACATACTTCCAGCACTGGGGCCAGGGCACCCTGGTCA<br>CCGTCTCCTCAGGTGAGTCTGCTGTCTGGGGATAGCGGGGAGCCAGGT<br>GTACTGGGCCAGGCAAGAAGAGCTGGTACAGTGCTGATGGCGCGAGGG<br>AGGC | SEQ ID NO:<br>5598 |
| hsIGH_2021_D021_J001_IGHD5-<br>18_IGHJ1 | GCCTTGCCAGCCCGCTCAGTATCGCTCGTACAGTGGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCGTAC<br>AGTGGTCGACATACTTCCAGCACTGGGGCCAGGGCACCCTGGTCACCG<br>TCTCCTCAGGTGAGTCTGCTGTCTGGGGATAGCGGGGAGCCAGGTGTA<br>CTGGGCCAGGCAAGTATCGCTCGTACAGTGCTGATGGCGCGAGGGAGG<br>C | SEQ ID NO:<br>5599 |
| hsIGH_2022_D022_J001_IGHD5-<br>24_IGHJ1 | GCCTTGCCAGCCCGCTCAGTCAGATGCGTACAGTGGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCGTAC<br>AGTGGTCGACATACTTCCAGCACTGGGGCCAGGGCACCCTGGTCACCG<br>TCTCCTCAGGTGAGTCTGCTGTCTGGGGATAGCGGGGAGCCAGGTGTA<br>CTGGGCCAGGCAAGTCAGATGCGTACAGTGCTGATGGCGCGAGGGAGG<br>C | SEQ ID NO:<br>5600 |
| hsIGH_2023_D023_J001_IGHD6-<br>06_IGHJ1 | GCCTTGCCAGCCCGCTCAGGTGTAGCAGTACAGTGAGGCAGCTGACTC<br>CTGACTTGGACGCCTATTCCAGACACCAGACGAGGGGCAGGCCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCAGTACAG<br>TGGTCGACATACTTCCAGCACTGGGGCCAGGGCACCCTGGTCACCGTC<br>TCCTCAGGTGAGTCTGCTGTCTGGGGATAGCGGGGAGCCAGGTGTACT<br>GGGCCAGGCAAGGTGTAGCAGTACAGTGCTGATGGCGCGAGGGAGGC | SEQ ID NO:<br>5601 |
| hsIGH_2024_D024_J001_IGHD6-<br>13_IGHJ1 | GCCTTGCCAGCCCGCTCAGTGGCAGTTGTACAGTGAGGCAGCTGACCC<br>CTGACTTGGACCCCTATTCCAGACACCAGACAGAGGCGCAGGCCCCCC<br>AGAACCAGGGTTGAGGGACGCCCCGTCAAAGCCAGACAAAACCAAGGG<br>GTGTTGAGCCCAGCAAGGGAAGGCCCCCAAACAGACCAGGAGGTTTCT<br>GAAGGTGTCTGTGTCACAGTGGGGTATAGCAGCAGCTTGGCAGTTGTA<br>CAGTGGTCGACATACTTCCAGCACTGGGGCCAGGGCACCCTGGTCACC<br>GTCTCCTCAGGTGAGTCTGCTGTCTGGGGATAGCGGGGAGCCAGGTGT<br>ACTGGGCCAGGCAAGTGGCAGTTGTACAGTGCTGATGGCGCGAGGGAG<br>GC | SEQ ID NO:<br>5602 |
| hsIGH_2025_D025_J001_IGHD6-<br>19_IGHJ1 | GCCTTGCCAGCCCGCTCAGCAGTCCAAGTACAGTGTGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAAGTA | SEQ ID NO:<br>5603 |

INFORMAL SEQUENCE LISTING

| | | |
|---|---|---|
| | CAGTGGTCGACATACTTCCAGCACTGGGGCCAGGGCACCCTGGTCACC<br>GTCTCCTCAGGTGAGTCTGCTGTCTGGGGATAGCGGGGAGCCAGGTGT<br>ACTGGGCCAGGCAAGCAGTCCAAGTACAGTGCTGATGGCGCGAGGGAG<br>GC | |
| hsIGH_2026_D026_J001_IGHD6-<br>25_IGHJ1 | GCCTTGCCAGCCCGCTCAGTACGTACGGTACAGTGCAGCTGGCCTCTG<br>TCTCGGACCCCCATTCCAGACACCAGACAGAGGGACAGGCCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGGTACAG<br>TGGTCGACATACTTCCAGCACTGGGGCCAGGGCACCCTGGTCACCGTC<br>TCCTCAGGTGAGTCTGCTGTCTGGGGATAGCGGGGAGCCAGGTGTACT<br>GGGCCAGGCAAGTACGTACGGTACAGTGCTGATGGCGCGAGGGAGGC | SEQ ID NO:<br>5604 |
| hsIGH_2027_D027_J001_IGHD7-<br>27_IGHJ1 | GCCTTGCCAGCCCGCTCAGAGTACCGAGTACAGTGAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT<br>GGCTGAGCTGAGAACCACTGTGCTAACTAGTACCGAGTACAGTGGTCG<br>ACATACTTCCAGCACTGGGGCCAGGGCACCCTGGTCACCGTCTCCTCA<br>GGTGAGTCTGCTGTCTGGGGATAGCGGGGAGCCAGGTGTACTGGGCCA<br>GGCAAGAGTACCGAGTACAGTGCTGATGGCGCGAGGGAGGC | SEQ ID NO:<br>5605 |
| hsIGH_2028_D001_J002_IGHD1-<br>01_IGHJ2 | GCCTTGCCAGCCCGCTCAGGACACTCTGGATCATCGCCCCGGTCTCTG<br>TGGGTGTTCCGCTAACTGGGGCTCCCAGTGCTCACCCCACAACTAAAG<br>CGAGCCCCAGCCTCCAGAGCCCCGAAGGAGATGCCGCCCACAAGCCC<br>AGCCCCCATCCAGGAGGCCCCAGAGCTCAGGGCGCCGGGGCAGATTCT<br>GAACAGCCCCGAGTCACGGTGGGTACAACTGGAGACACTCTGGATCAT<br>CGTCGACTGCTGGGGGCCCCTGGACCCGACCCGCCCTGGAGACCGCAG<br>CCACATCAGCCCCCAGCCCCACAGGCCCCCTACCAGCCGCAGGGTTTT<br>GGCTGAGCTGAGACACTCTGGATCATCCTGATGGCGCGAGGGAGGC | SEQ ID NO:<br>5606 |
| hsIGH_2029_D002_J002_IGHD1-<br>07_IGHJ2 | GCCTTGCCAGCCCGCTCAGTTCGGAACGGATCATCGGCCTCGGTCTCT<br>GTGGGTGTTCCGCTAGCTGGGGCTCACAGTGCTCACCCCACACCTAAA<br>ACGAGCCACAGCCTCAGAGCCCCTGAAGGAGACCCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACGGATCAT<br>CGTCGACTGCTGGGGGCCCCTGGACCCGACCCGCCCTGGAGACCGCAG<br>CCACATCAGCCCCCAGCCCCACAGGCCCCCTACCAGCCGCAGGGTTTT<br>GGCTGAGCTGATTCGGAACGGATCATCCTGATGGCGCGAGGGAGGC | SEQ ID NO:<br>5607 |
| hsIGH_2030_D003_J002_IGHD1-<br>14_IGHJ2 | GCCTTGCCAGCCCGCTCAGAAGTAACGGGATCATCGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGGGATCAT<br>CGTCGACTGCTGGGGGCCCCTGGACCCGACCCGCCCTGGAGACCGCAG<br>CCACATCAGCCCCCAGCCCCACAGGCCCCCTACCAGCCGCAGGGTTTT<br>GGCTGAGCTGAAAGTAACGGGATCATCCTGATGGCGCGAGGGAGGC | SEQ ID NO:<br>5608 |
| hsIGH_2031_D004_J002_IGHD1-<br>20_IGHJ2 | GCCTTGCCAGCCCGCTCAGGTCTCCTAGGATCATCGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTAGGATCAT<br>CGTCGACTGCTGGGGGCCCCTGGACCCGACCCGCCCTGGAGACCGCAG<br>CCACATCAGCCCCCAGCCCCACAGGCCCCCTACCAGCCGCAGGGTTTT<br>GGCTGAGCTGAGTCTCCTAGGATCATCCTGATGGCGCGAGGGAGGC | SEQ ID NO:<br>5609 |
| hsIGH_2032_D005_J002_IGHD1-<br>26_IGHJ2 | GCCTTGCCAGCCCGCTCAGAGAGTGTCGGATCATCAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCGGAT<br>CATCGTCGACTGCTGGGGGCCCCTGGACCCGACCCGCCCTGGAGACCG<br>CAGCCACATCAGCCCCCAGCCCCACAGGCCCCCTACCAGCCGCAGGGT<br>TTTGGCTGAGCTGAAGAGTGTCGGATCATCCTGATGGCGCGAGGGAGG<br>C | SEQ ID NO:<br>5610 |
| hsIGH_2033_D006_J002_IGHD2-<br>02_IGHJ2 | GCCTTGCCAGCCCGCTCAGGTTCCGAAGGATCATCAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG | SEQ ID NO:<br>5611 |

-continued

| INFORMAL SEQUENCE LISTING | | |
|---|---|---|
| | TTCCGAAGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGAGTTCCGAAGGATCATCCTGATGG<br>CGCGAGGGAGGC | |
| hsIGH_2034_D007_J002_IGHD2-<br>08_IGHJ2 | GCCTTGCCAGCCCGCTCAGCGTTACTTGGATCATCAAAGGAGGAGCCC<br>CTTGTTCAGCACTGGGCTCAGAGTCCTCTCCAAGCACACCCAGAGTTTC<br>AGACAAAAACCCCCTGGAATGCACAGTCTCAGCAGGAGAGCCAGCCAG<br>AGCCAGCAAGATGGGCTCAGTGACACCCGCAGGGACAGGAGGATTTT<br>GTGGGGGCTCGTGTCACTGTGAGGATATTGTACTAATGGTGTATGCTC<br>GTTACTTGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGACGTTACTTGGATCATCCTGATGG<br>CGCGAGGGAGGC | SEQ ID NO:<br>5612 |
| hsIGH_2035_D008_J002_IGHD2-<br>15_IGHJ2 | GCCTTGCCAGCCCGCTCAGTAGGAGACGGATCATCAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGATAGGAGACGGATCATCCTGATGG<br>CGCGAGGGAGGC | SEQ ID NO:<br>5613 |
| hsIGH_2036_D009_J002_IGHD2-<br>21_IGHJ2 | GCCTTGCCAGCCCGCTCAGGTGTCTACGGATCATCAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT<br>CTACGGATCATCGTCGACTGCTGGGGCCCCTGGACCCGACCCGCCCT<br>GGGAGACCGCAGCCACATCAGCCCCCAGCCCCACAGGCCCCCTACCAGC<br>CGCAGGGTTTTGGCTGAGCTGAGTGTCTACGGATCATCCTGATGGCGC<br>GAGGGAGGC | SEQ ID NO:<br>5614 |
| hsIGH_2037_D010_J002_IGHD3-<br>03_IGHJ2 | GCCTTGCCAGCCCGCTCAGTGCTACACGGATCATCGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGATGCTACACGGATCATCCTGATGG<br>CGCGAGGGAGGC | SEQ ID NO:<br>5615 |
| hsIGH_2038_D011_J002_IGHD3-<br>09_IGHJ2 | GCCTTGCCAGCCCGCTCAGAACTGCCAGGATCATCTGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCAGGTTTCCCCAGGCCTGCCGGTAGGTTTAG<br>AATGAGGTCTGTGTCACTGTGGTATTACGATATTTTGACTGGTTATTA<br>ACTGCCAGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGAAACTGCCAGGATCATCCTGATGG<br>CGCGAGGGAGGC | SEQ ID NO:<br>5616 |
| hsIGH_2039_D012_J002_IGHD3-<br>10_IGHJ2 | GCCTTGCCAGCCCGCTCAGTTGGACTGGGATCATCCGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGGGATCATCGTCGACTGCTGGGGCCCCTGGACCCGACCCGC<br>CCTGGAGACCGCAGCCACATCAGCCCCCAGCCCCACAGGCCCCCTACC<br>AGCCGCAGGGTTTTGGCTGAGCTGATTGGACTGGGATCATCCTGATGG<br>CGCGAGGGAGGC | SEQ ID NO:<br>5617 |
| hsIGH_2040_D013_J002_IGHD3-<br>16_IGHJ2 | GCCTTGCCAGCCCGCTCAGGTAGACACGGATCATCTGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACGGATCATCGTCGACTGCTGGGGCCCCTGGACCCG<br>ACCCGCCCTGGAGACCGCAGCCACATCAGCCCCCAGCCCCACAGGCCC<br>CCTACCAGCCGCAGGGTTTTGGCTGAGCTGAGTAGACACGGATCATCC<br>TGATGGCGCGAGGGAGGC | SEQ ID NO:<br>5618 |

| | INFORMAL SEQUENCE LISTING | |
|---|---|---|
| hsIGH_2041_D014_J002_IGHD3-22_IGHJ2 | GCCTTGCCAGCCCGCTCAGCACTGTACGGATCATCTGGGCATGGACAG TGTCCACCTAAGCGAGGGACAGACCCGAGTGTCCCTGCAGTAGACCTG AGAGCGCTGGGCCCACAGCCTCCCCTCGGGGCCCTGCTGCCTCCTCAG GTCAGCCCTGGACATCCCGGGTTTCCCCAGGCCTGGCGGTAGGTTTGA AGTGAGGTCTGTGTCACTGTGGTATTACTATGATAGTAGTGGTTATTC ACTGTACGGATCATCGTCGACTGCTGGGGGCCCCTGGACCCGACCCGC CCTGGAGACCGCAGCCACATCAGCCCCAGCCCCACAGGCCCCCTACC AGCCGCAGGGTTTTGGCTGAGCTGACACTGTACGGATCATCCTGATGG CGCGAGGGAGGC | SEQ ID NO: 5619 |
| hsIGH_2042_D015_J002_IGHD4-04_IGHJ2 | GCCTTGCCAGCCCGCTCAGGATGATCCGGATCATCCAAGGGTGAGTCA GACCCTCCTGCCCTCGATGGCAGGCGGAGAAGATTCAGAAAGGTCTGA GATCCCCAGGACGCAGCACCACTGTCAATGGGGGCCCCAGACGCCTGG ACCAGGGCCTGCGTGGGAAAGGCCTCTGGGCACACTCAGGGGCTTTTT GTGAAGGGTCCTCCTACTGTGTGACTACAGTAGATGATCCGGATCATC GTCGACTGCTGGGGGCCCCTGGACCCGACCCGCCCTGGAGACCGCAGC CACATCAGCCCCAGCCCCACAGGCCCCTACCAGCCGCAGGGTTTTG GCTGAGCTGAGATGATCCGGATCATCCTGATGGCGCGAGGGAGGC | SEQ ID NO: 5620 |
| hsIGH_2043_D016_J002_IGHD4-11_IGHJ2 | GCCTTGCCAGCCCGCTCAGCGCCAATAGGATCATCTGCCTCTCTCCCC AGTGGACACCCTCTTCCAGGACAGTCCTCAGTGGCATCACAGCGGCCT GAGATCCCCAGGACGCAGCACCGCTGTCAATAGGGGCCCCAAATGCCT GGACCAGGGCCTGCGTGGGAAAGGTCTCTGGCCACACTCGGGCTTTTT GTGAAGGGCCCTCCTGCTGTGTGACTACAGTACGCCAATAGGATCATC GTCGACTGCTGGGGGCCCCTGGACCCGACCCGCCCTGGAGACCGCAGC CACATCAGCCCCAGCCCCACAGGCCCCTACCAGCCGCAGGGTTTTG GCTGAGCTGACGCCAATAGGATCATCCTGATGGCGCGAGGGAGGC | SEQ ID NO: 5621 |
| hsIGH_2044_D017_J002_IGHD4-17_IGHJ2 | GCCTTGCCAGCCCGCTCAGTCAAGCCTGGATCATCGGAGGGTGAGTCA GACCCACCTGCCCTCGATGGCAGGCGGGGAAGATTCAGAAAGGCCTGA GATCCCCAGGACGCAGCACCACTGTCAATGGGGGCCCCAGACGCCTGG ACCAGGGCCTGCGTGGGAAAGGCCGCTGGGCACACTCAGGGGCTTTTT GTGAAGGCCCCTCCTACTGTGTGACTACGGTGTCAAGCCTGGATCATC GTCGACTGCTGGGGGCCCCTGGACCCGACCCGCCCTGGAGACCGCAGC CACATCAGCCCCAGCCCCACAGGCCCCTACCAGCCGCAGGGTTTTG GCTGAGCTGATCAAGCCTGGATCATCCTGATGGCGCGAGGGAGGC | SEQ ID NO: 5622 |
| hsIGH_2045_D018_J002_IGHD4-23_IGHJ2 | GCCTTGCCAGCCCGCTCAGACGTGTGTGGATCATCGGAGGGTGAGTCA GACCCACCTGCCCTCAATGGCAGGCGGGGAAGATTCAGAAAGGCCTGA GATCCCCAGGACGCAGCACCACTGTCAATGGGGGCCCCAGACGCCTGG ACCAGGGCCTGTGTGGGAAAGGCCTCTGGCCACACTCAGGGGCTTTTT GTGAAGGGCCCTCCTGCTGTGTGACTACGGTGGTAACGTGTGTGGATC ATCGTCGACTGCTGGGGGCCCCTGGACCCGACCCGCCCTGGAGACCGC AGCCACATCAGCCCCAGCCCCACAGGCCCCCTACCAGCCGCAGGGTT TTGGCTGAGCTGAACGTGTGTGGATCATCCTGATGGCGCGAGGGAGGC | SEQ ID NO: 5623 |
| hsIGH_2046_D019_J002_IGHD5-05_IGHJ2 | GCCTTGCCAGCCCGCTCAGTCCGTCTAGGATCATCAGAGGCCTCTCCA GGGGGACACTGTGCATGTCTGGTCCCTGAGCAGCCCCCCATGTCCCA GTCCTGGGGGCCCCTGGCACAGCTGTCTGGACCCTCTCTATTCCCT GGGAAGCTCCTCCTGACAGCCCCGCCTCCAGTTCCAGGTGTGGTTATT GTCAGGGGTGTCAGACTGTGGTGGATACAGCTATGTCCGTCTAGGAT CATCGTCGACTGCTGGGGGCCCCTGGACCCGACCCGCCCTGGAGACCG CAGCCACATCAGCCCCAGCCCCACAGGCCCCTACCAGCCGCAGGGT TTTGGCTGAGCTGATCCGTCTAGGATCATCCTGATGGCGCGAGGGAGG C | SEQ ID NO: 5624 |
| hsIGH_2047_D020_J002_IGHD5-12_IGHJ2 | GCCTTGCCAGCCCGCTCAGAAGAGCTGGGATCATCGCAGAGGCCTCTC CAGGGAGACACTGTGCATGTCTGGTACCTAAGCAGCCCCCCACGTCCC CAGTCCTGGGGGCCCCTGGCTCAGCTGTCTGGACCCTCCCTGTTCCCT GGGAAGCTCCTCCTGACAGCCCCGCCTCCAGTTCCAGGTGTGGTTATT GTCAGGCGATGTCAGACTGTGGTGGATATAGTGGCTACGAAGAGCTGG GATCATCGTCGACTGCTGGGGGCCCCTGGACCCGACCCGCCCTGGAGA CCGCAGCCACATCAGCCCCAGCCCCACAGGCCCCTACCAGCCGCAG GGTTTTGGCTGAGCTGAAAGAGCTGGGATCATCCTGATGGCGCGAGGG AGGC | SEQ ID NO: 5625 |
| hsIGH_2048_D021_J002_IGHD5-18_IGHJ2 | GCCTTGCCAGCCCGCTCAGTATCGCTCGGATCATCGCAGAGGCCTCTC CAGGGGGACACTGTGCATGTCTGGTCCCTGAGCAGCCCCCCACGTCCC CAGTCCTGGGGGCCCCTGGCACAGCTGTCTGGACCCTCCCTGTTCCCT GGGAAGCTCCTCCTGACAGCCCCGCCTCCAGTTCCAGGTGTGGTTATT GTCAGGGGGTGTCAGACTGTGGTGGATACAGCTATGTATCGCTCGGAT CATCGTCGACTGCTGGGGGCCCCTGGACCCGACCCGCCCTGGAGACCG CAGCCACATCAGCCCCAGCCCCACAGGCCCCTACCAGCCGCAGGGT TTTGGCTGAGCTGATATCGCTCGGATCATCCTGATGGCGCGAGGGAGG C | SEQ ID NO: 5626 |

| INFORMAL SEQUENCE LISTING | | |
|---|---|---|
| hsIGH_2049_D022_J002_IGHD5-24_IGHJ2 | GCCTTGCCAGCCCGCTCAGTCAGATGCGGATCATCGCAGAGGCCTCTC CAGGGGGACACAGTGCATGTCTGGTCCCTGAGCAGCCCCCAGGCTCTC TAGCACTGGGGGCCCCTGGCACAGCTGTCTGGACCCTCCCTGTTCCCT GGGAAGCTCCTCCTGACAGCCCCGCCTCCAGTTCCAGGTGTGGTTATT GTCAGGGGGTGCCAGGCCGTGGTAGAGATGGCTACATCAGATGCGGAT CATCGTCGACTGCTGGGGGCCCCTGGACCCGACCCGCCCTGGAGACCG CAGCCACATCAGCCCCAGCCCCACAGGCCCCCTACCAGCCGCAGGGT TTTTGGCTGAGCTGATCAGATGCGGATCATCCTGATGGCGCGAGGGAGG C | SEQ ID NO: 5627 |
| hsIGH_2050_D023_J002_IGHD6-06_IGHJ2 | GCCTTGCCAGCCCGCTCAGGTGTAGCAGGATCATCAGGCAGCTGACTC CTGACTTGGACGCCTATTCCAGACACCAGACAGAGGGGCAGGCCCCCC AGAACCAGGGATGAGGACGCCCCGTCAAGGCCAGAAAAGACCAAGTTG TGCTGAGCCCAGCAAGGGAAGGTCCCCAAACAAACCAGGAACGTTTCT GAAGGTGTCTGTGTCACAGTGGAGTATAGCAGCTGTGTAGCAGGATCA TCGTCGACTGCTGGGGGCCCCTGGACCCGACCCGCCCTGGAGACCGCA GCCACATCAGCCCCAGCCCCACAGGCCCCTACCAGCCGCAGGGTTT TGGCTGAGCTGAGTGTAGCAGGATCATCCTGATGGCGCGAGGGAGGC | SEQ ID NO: 5628 |
| hsIGH_2051_D024_J002_IGHD6-13_IGHJ2 | GCCTTGCCAGCCCGCTCAGTGGCAGTTGGATCATCAGGCAGCTGACCC CTGACTTGGACCCCTATTCCAGACACCAGACAGAGGCGCAGGCCCCCC AGAACCAGGGTTGAGGGACGCCCCGTCAAAGCCAGACAAAACCAAGGG GTGTTGAGCCCAGCAAGGGAAGGCCCCCAAACAGACCAGGAGGTTTCT GAAGGTGTCTGTGTCACAGTGGGGTATAGCAGCAGCTTGGCAGTTGGA TCATCGTCGACTGCTGGGGGCCCCTGGACCCGACCCGCCCTGGAGACC GCAGCCACATCAGCCCCAGCCCCACAGGCCCCCTACCAGCCGCAGGG TTTTGGCTGAGCTGATGGCAGTTGGATCATCCTGATGGCGCGAGGGAG GC | SEQ ID NO: 5629 |
| hsIGH_2052_D025_J002_IGHD6-19_IGHJ2 | GCCTTGCCAGCCCGCTCAGCAGTCCAAGGATCATCTGAGGTAGCTGGC CTCTGTCTCGGACCCCACTCCAGACACCAGACAGAGGGGCAGGCCCCC CAAAACCAGGGTTGAGGGATGATCCGTCAAGGCAGACAAGACCAAGGG GCACTGACCCCAGCAAGGGAAGGCTCCCAAACAGACGAGGAGGTTTCT GAAGCTGTCTGTATCACAGTGGGGTATAGCAGTGGCTCAGTCCAAGGA TCATCGTCGACTGCTGGGGGCCCCTGGACCCGACCCGCCCTGGAGACC GCAGCCACATCAGCCCCAGCCCCACAGGCCCCCTACCAGCCGCAGGG TTTTGGCTGAGCTGACAGTCCAAGGATCATCCTGATGGCGCGAGGGAG GC | SEQ ID NO: 5630 |
| hsIGH_2053_D026_J002_IGHD6-25_IGHJ2 | GCCTTGCCAGCCCGCTCAGTACGTACGGGATCATCCAGCTGGCCTCTG TCTCGGACCCCCATTCCAGACACCAGACAGAGGGACAGGCCCCCCAGA ACCAGTGTTGAGGGACACCCCTGTCCAGGGCAGCCAAGTCCAAGAGGC GCGCTGAGCCCAGCAAGGGAAGGCCCCCAAACAAACCAGGAGGTTTCT GAAGCTGTCTGTGTCACAGTCGGGTATAGCAGCGTACGTACGGGATCA TCGTCGACTGCTGGGGGCCCCTGGACCCGACCCGCCCTGGAGACCGCA GCCACATCAGCCCCAGCCCCACAGGCCCCCTACCAGCCGCAGGGTTT TGGCTGAGCTGATACGTACGGGATCATCCTGATGGCGCGAGGGAGGC | SEQ ID NO: 5631 |
| hsIGH_2054_D027_J002_IGHD7-27_IGHJ2 | GCCTTGCCAGCCCGCTCAGAGTACCGAGGATCATCAGGGTTGAGGGCT GGGGTCTCCCACGTGTTTTGGGGCTAACAGCGGAAGGGAGAGCACTGG CAAAGGTGCTGGGGGTCCCCTGAACCCGACCCGCCCTGAGACCGCAGC CACATCAGCCCCAGCCCCACAGGCCCCCTACCAGCCGCAGGGTTTTT GGCTGAGCTGAGAACCACTGTGCTAACTAGTACCGAGGATCATCGTCG ACTGCTGGGGGCCCCTGGACCCGACCCGCCCTGGAGACCGCAGCCACA TCAGCCCCCAGCCCCACAGGCCCCTACCAGCCGCAGGGTTTTGGCTG AGCTGAAGTACCGAGGATCATCCTGATGGCGCGAGGGAGGC | SEQ ID NO: 5632 |
| hsIGH_2055_D001_J003_IGHD1-01_IGHJ3 | GCCTTGCCAGCCCGCTCAGGACACTCTTATTGGCGGCCCCGGTCTCTG TGGGTGTTCCGCTAACTGGGGCTCCCAGTGCTCACCCCACAACTAAAG CGAGCCCCAGCCTCCAGAGCCCCGAAGGAGATGCCGCCCACAAGCCC AGCCCCCATCCAGGAGGCCCCAGAGCTCAGGGCGCCGGGGCAGATTCT GAACAGCCCCGAGTCACGGTGGGTACAACTGGAGACACTCTTATTGGC GGTCGACGGTACTTCGATCTCTGGGGCGTGGCACCCTGGTCACTGTC TCCTCAGGTGAGTCCCACTGCAGCCCCTCCCAGTCTTCTCTGTCCAG GCACCAGGCCAGACACTCTTATTGGCGCTGATGGCGCGAGGGAGGC | SEQ ID NO: 5633 |
| hsIGH_2056_D002_J003_IGHD1-07_IGHJ3 | GCCTTGCCAGCCCGCTCAGTTCGGAACTATTGGCGGGCCTCGGTCTCT GTGGGTGTTCCGCTAGCTGGGGCTCACAGTGCTCACCCCACACCTAAA ACGAGCCACAGCCTCAGAGCCCCTGAAGGAGACCCCGCCCACAAGCCC AGCCCCCACCCAGGAGGCCCCAGAGCACAGGGCGCCCCGTCGGATTCT GAACAGCCCCGAGTCACAGTGGGTATAACTGGATTCGGAACTATTGGC GGTCGACGGTACTTCGATCTCTGGGGCCGTGGCACCCTGGTCACTGTC TCCTCAGGTGAGTCCCACTGCAGCCCCCTCCCAGTCTTCTCTGTCCAG GCACCAGGCCATTCGGAACTATTGGCGCTGATGGCGCGAGGGAGGC | SEQ ID NO: 5634 |

INFORMAL SEQUENCE LISTING

| | | |
|---|---|---|
| hsIGH_2057_D003_J003_IGHD1-14_IGHJ3 | GCCTTGCCAGCCCGCTCAGAAGTAACGTATTGGCGGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGTATTGGC<br>GGTCGACGGTACTTCGATCTCTGGGGCCGTGGCACCCTGGTCACTGTC<br>TCCTCAGGTGAGTCCCACTGCAGCCCCTCCCAGTCTTCTCTGTCCAG<br>GCACCAGGCCAAAGTAACGTATTGGCGCTGATGGCGCGAGGGAGGC | SEQ ID NO:<br>5635 |
| hsIGH_2058_D004_J003_IGHD1-20_IGHJ3 | GCCTTGCCAGCCCGCTCAGGTCTCCTATATTGGCGGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTATATTGGC<br>GGTCGACGGTACTTCGATCTCTGGGGCCGTGGCACCCTGGTCACTGTC<br>TCCTCAGGTGAGTCCCACTGCAGCCCCTCCCAGTCTTCTCTGTCCAG<br>GCACCAGGCCAGTCTCCTATATTGGCGCTGATGGCGCGAGGGAGGC | SEQ ID NO:<br>5636 |
| hsIGH_2059_D005_J003_IGHD1-26_IGHJ3 | GCCTTGCCAGCCCGCTCAGAGAGTGTCTATTGGCGAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCTATT<br>GGCGGTCGACGGTACTTCGATCTCTGGGGCCGTGGCACCCTGGTCACT<br>GTCTCCTCAGGTGAGTCCCACTGCAGCCCCTCCCAGTCTTCTCTGTC<br>CAGGCACCAGGCCAAGAGTGTCTATTGGCGCTGATGGCGCGAGGGAGG<br>C | SEQ ID NO:<br>5637 |
| hsIGH_2060_D006_J003_IGHD2-02_IGHJ3 | GCCTTGCCAGCCCGCTCAGGTTCCGAATATTGGCGAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAATATTGGCGGTCGACGGTACTTCGATCTCTGGGGCCGTGGCA<br>CCCTGGTCACTGTCTCCTCAGGTGAGTCCCACTGCAGCCCCCTCCCAG<br>TCTTCTCTGTCCAGGCACCAGGCCAGTTCCGAATATTGGCGCTGATGG<br>CGCGAGGGAGGC | SEQ ID NO:<br>5638 |
| hsIGH_2061_D007_J003_IGHD2-08_IGHJ3 | GCCTTGCCAGCCCGCTCAGCGTTACTTTATTGGCGAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTTATTGGCGGTCGACGGTACTTCGATCTCTGGGGCCGTGGCA<br>CCCTGGTCACTGTCTCCTCAGGTGAGTCCCACTGCAGCCCCCTCCCAG<br>TCTTCTCTGTCCAGGCACCAGGCCACGTTACTTTATTGGCGCTGATGG<br>CGCGAGGGAGGC | SEQ ID NO:<br>5639 |
| hsIGH_2062_D008_J003_IGHD2-15_IGHJ3 | GCCTTGCCAGCCCGCTCAGTAGGAGACTATTGGCGAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACTATTGGCGGTCGACGGTACTTCGATCTCTGGGGCCGTGGCA<br>CCCTGGTCACTGTCTCCTCAGGTGAGTCCCACTGCAGCCCCCTCCCAG<br>TCTTCTCTGTCCAGGCACCAGGCCATAGGAGACTATTGGCGCTGATGG<br>CGCGAGGGAGGC | SEQ ID NO:<br>5640 |
| hsIGH_2063_D009_J003_IGHD2-21_IGHJ3 | GCCTTGCCAGCCCGCTCAGGTGTCTACTATTGGCGAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT<br>CTACTATTGGCGGTCGACGGTACTTCGATCTCTGGGGCCGTGGCACCC<br>TGGTCACTGTCTCCTCAGGTGAGTCCCACTGCAGCCCCCTCCCAGTCT<br>TCTCTGTCCAGGCACCAGGCCAGTGTCTACTATTGGCGCTGATGGCGC<br>GAGGGAGGC | SEQ ID NO:<br>5641 |
| hsIGH_2064_D010_J003_IGHD3-03_IGHJ3 | GCCTTGCCAGCCCGCTCAGTGCTACACTATTGGCGGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACTATTGGCGGTCGACGGTACTTCGATCTCTGGGGCCGTGGCA | SEQ ID NO:<br>5642 |

| | INFORMAL SEQUENCE LISTING | |
|---|---|---|
| | CCCTGGTCACTGTCTCCTCAGGTGAGTCCCACTGCAGCCCCCTCCCAG TCTTCTCTGTCCAGGCACCAGGCCATGCTACACTATTGGCGCTGATGG CGCGAGGGAGGC | |
| hsIGH_2065_D011_J003_IGHD3-09_IGHJ3 | GCCTTGCCAGCCCGCTCAGAACTGCCATATTGGCGTGGGCACGGACAC TATCCACATAAGCGAGGGATAGACCCGAGTGTCCCCACAGCAGACCTG AGAGCGCTGGGCCCACAGCCTCCCCTCAGAGCCCTGCTGCCTCCTCCG GTCAGCCCTGGACATCCCAGGTTTCCCCAGGCCTGCCGGTAGGTTTAG AATGAGGTCTGTGTCACTGTGGTATTACGATATTTTGACTGGTTATTA ACTGCCATATTGGCGGTCGACGGTACTTCGATCTCTGGGGCCGTGGCA CCCTGGTCACTGTCTCCTCAGGTGAGTCCCACTGCAGCCCCCTCCCAG TCTTCTCTGTCCAGGCACCAGGCCAAACTGCCATATTGGCGCTGATGG CGCGAGGGAGGC | SEQ ID NO: 5643 |
| hsIGH_2066_D012_J003_IGHD3-10_IGHJ3 | GCCTTGCCAGCCCGCTCAGTTGGACTGTATTGGCGCGATATTTTGACT GGTTATTATAACCACAGTGTCACAGAGTCCATCAAAAACCCATGCCTG GAAGCTTCCCGCCACAGCCCTCCCCATGGGGCCCTGCTGCCTCCTCAG GTCAGCCCCGGACATCCCGGTTTCCCCAGGCTGGCGGTAGGTTTGG GGTGAGGTCTGTGTCACTGTGGTATTACTATGGTTCGGGGAGTTATTT TGGACTGTATTGGCGGTCGACGGTACTTCGATCTCTGGGGCCGTGGCA CCCTGGTCACTGTCTCCTCAGGTGAGTCCCACTGCAGCCCCCTCCCAG TCTTCTCTGTCCAGGCACCAGGCCATTGGACTGTATTGGCGCTGATGG CGCGAGGGAGGC | SEQ ID NO: 5644 |
| hsIGH_2067_D013_J003_IGHD3-16_IGHJ3 | GCCTTGCCAGCCCGCTCAGGTAGACACTATTGGCGTGGACGCGGACAC TATCCACATAAGCGAGGGACAGACCCGAGTGTTCCTGCAGTAGACCTG AGAGCGCTGGGCCCACAGCCTCCCCTCGGTGCCCTGCTGCCTCCTCAG GTCAGCCCTGGACATCCCGGTTTCCCCAGGCCAGATGGTAGGTTTGA AGTGAGGTCTGTGTCACTGTGGTATTATGATTACGTTTGGGGGAGTTA TCGTTGTAGACACTATTGGCGGTCGACGGTACTTCGATCTCTGGGGCC GTGGCACCCTGGTCACTGTCTCCTCAGGTGAGTCCCACTGCAGCCCCC TCCCAGTCTTCTCTGTCCAGGCACCAGGCCAGTAGACACTATTGGCGC TGATGGCGCGAGGGAGGC | SEQ ID NO: 5645 |
| hsIGH_2068_D014_J003_IGHD3-22_IGHJ3 | GCCTTGCCAGCCCGCTCAGCACTGTACTATTGGCGTGGGCATGGACAG TGTCCACCTAAGCGAGGGACAGACCCGAGTGTCCCTGCAGTAGACCTG AGAGCGCTGGGCCCACAGCCTCCCCTCGGGGCCCTGCTGCCTCCTCAG GTCAGCCCTGGACATCCCGGTTTCCCCAGGCCTGGCGGTAGGTTTGA AGTGAGGTCTGTGTCACTGTGGTATTACTATGATAGTAGTGGTTATTC ACTGTACTATTGGCGGTCGACGGTACTTCGATCTCTGGGGCCGTGGCA CCCTGGTCACTGTCTCCTCAGGTGAGTCCCACTGCAGCCCCCTCCCAG TCTTCTCTGTCCAGGCACCAGGCCACACTGTACTATTGGCGCTGATGG CGCGAGGGAGGC | SEQ ID NO: 5646 |
| hsIGH_2069_D015_J003_IGHD4-04_IGHJ3 | GCCTTGCCAGCCCGCTCAGGATGATCCTATTGGCGCAAGGGTGAGTCA GACCCTCCTGCCCTCGATGGCAGGCGGAGAAGATTCAGAAAGGTCTGA GATCCCCAGGACGCAGCACCACTGTCAATGGGGGCCCCAGACGCCTGG ACCAGGGCCTGCGTGGGAAAGGCCTCTGGGCACACTCAGGGGCTTTTT GTGAAGGGTCCTCCTACTGTGTGACTACAGTAGATGATCCTATTGGCG GTCGACGGTACTTCGATCTCTGGGGCCGTGGCACCCTGGTCACTGTCT CCTCAGGTGAGTCCCACTGCAGCCCCCTCCCAGTCTTCTCTGTCCAGG CACCAGGCCAGATGATCCTATTGGCGCTGATGGCGCGAGGGAGGC | SEQ ID NO: 5647 |
| hsIGH_2070_D016_J003_IGHD4-11_IGHJ3 | GCCTTGCCAGCCCGCTCAGCGCAATATATTGGCGTGCCTCTCTCCCC AGTGGACACCCTCTTCCAGGACAGTCCTCAGTGGCATCACAGCGGCCT GAGATCCCCAGGACGCAGCACCGCTGTCAATAGGGGCCCCAAATGCCT GGACCAGGGCCTGCGTGGGAAAGGTCTCTGGCCACACTCGGGCTTTTT GTGAAGGGCCCTCCTGCTGTGTGACTACAGTACGCCAATATATTGGCG GTCGACGGTACTTCGATCTCTGGGGCCGTGGCACCCTGGTCACTGTCT CCTCAGGTGAGTCCCACTGCAGCCCCCTCCCAGTCTTCTCTGTCCAGG CACCAGGCCACGCCAATATATTGGCGCTGATGGCGCGAGGGAGGC | SEQ ID NO: 5648 |
| hsIGH_2071_D017_J003_IGHD4-17_IGHJ3 | GCCTTGCCAGCCCGCTCAGTCAAGCTTATTGGCGGGAGGGTGAGTCA GACCCACCTGCCCTCGATGGCAGGCGGGAAGATTCAGAAAGGCCTGA GATCCCCAGGACGCAGCACCACTGTCAATGGGGGCCCCAGACGCCTGG ACCAGGGCCTGCGTGGGAAAGGCCGCTGGGCACACTCAGGGGCTTTTT GTGAAGGCCCTCCTACTGTGTGACTACGGTGTCAAGCCTTATTGGCG GTCGACGGTACTTCGATCTCTGGGGCCGTGGCACCCTGGTCACTGTCT CCTCAGGTGAGTCCCACTGCAGCCCCCTCCCAGTCTTCTCTGTCCAGG CACCAGGCCATCAAGCTTATTGGCGCTGATGGCGCGAGGGAGGC | SEQ ID NO: 5649 |
| hsIGH_2072_D018_J003_IGHD4-23_IGHJ3 | GCCTTGCCAGCCCGCTCAGACGTGTTATTGGCGGGAGGGTGAGTCA GACCCACCTGCCCTCAATGGCAGGCGGGAAGATTCAGAAAGGCCTGA GATCCCCAGGACGCAGCACCACTGTCAATGGGGGCCCCAGACGCCTGG ACCAGGGCCTGTGTGGGAAAGGCCTCTGGCCACACTCAGGGGCTTTTT GTGAAGGGCCCTCCTGCTGTGTGACTACGGTGGTAACGTGTGTTATTG GCGGTCGACGGTACTTCGATCTCTGGGGCCGTGGCACCCTGGTCACTG | SEQ ID NO: 5650 |

| INFORMAL SEQUENCE LISTING | | |
|---|---|---|
| | TCTCCTCAGGTGAGTCCCACTGCAGCCCCCTCCCAGTCTTCTCTGTCC<br>AGGCACCAGGCCAACGTGTGTTATTGGCGCTGATGGCGCGAGGGAGGC | |
| hsIGH_2073_D019_J003_IGHD5-<br>05_IGHJ3 | GCCTTGCCAGCCCGCTCAGTCCGTCTATATTGGCGAGAGGCCTCTCCA<br>GGGGGACACTGTGCATGTCTGGTCCCTGAGCAGCCCCCCATGTCCCCA<br>GTCCTGGGGGCCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTCCGTCTATATT<br>GGCGGTCGACGGTACTTCGATCTCTGGGGCCGTGGCACCCTGGTCACT<br>GTCTCCTCAGGTGAGTCCCACTGCAGCCCCCTCCCAGTCTTCTCTGTC<br>CAGGCACCAGGCCATCCGTCTATATTGGCGCTGATGGCGCGAGGGAGG<br>C | SEQ ID NO:<br>5651 |
| hsIGH_2074_D020_J003_IGHD5-<br>12_IGHJ3 | GCCTTGCCAGCCCGCTCAGAAGAGCTGTATTGGCGGCAGAGGCCTCTC<br>CAGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATAGTGGCTACGAAGAGCTGT<br>ATTGGCGGTCGACGGTACTTCGATCTCTGGGGCCGTGGCACCCTGGTC<br>ACTGTCTCCTCAGGTGAGTCCCACTGCAGCCCCCTCCCAGTCTTCTCT<br>GTCCAGGCACCAGGCCAAAGAGCTGTATTGGCGCTGATGGCGCGAGGG<br>AGGC | SEQ ID NO:<br>5652 |
| hsIGH_2075_D021_J003_IGHD5-<br>18_IGHJ3 | GCCTTGCCAGCCCGCTCAGTATCGCTCTATTGGCGGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCTATT<br>GGCGGTCGACGGTACTTCGATCTCTGGGGCCGTGGCACCCTGGTCACT<br>GTCTCCTCAGGTGAGTCCCACTGCAGCCCCCTCCCAGTCTTCTCTGTC<br>CAGGCACCAGGCCATATCGCTCTATTGGCGCTGATGGCGCGAGGGAGG<br>C | SEQ ID NO:<br>5653 |
| hsIGH_2076_D022_J003_IGHD5-<br>24_IGHJ3 | GCCTTGCCAGCCCGCTCAGTCAGATGCTATTGGCGGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCTATT<br>GGCGGTCGACGGTACTTCGATCTCTGGGGCCGTGGCACCCTGGTCACT<br>GTCTCCTCAGGTGAGTCCCACTGCAGCCCCCTCCCAGTCTTCTCTGTC<br>CAGGCACCAGGCCATCAGATGCTATTGGCGCTGATGGCGCGAGGGAGG<br>C | SEQ ID NO:<br>5654 |
| hsIGH_2077_D023_J003_IGHD6-<br>06_IGHJ3 | GCCTTGCCAGCCCGCTCAGGTGTAGCATATTGGCGAGGCAGCTGACTC<br>CTGACTTGGACGCCTATTCCAGACACCAGACAGAGGGGCAGGCCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCATATTGG<br>CGGTCGACGGTACTTCGATCTCTGGGGCCGTGGCACCCTGGTCACTGT<br>CTCCTCAGGTGAGTCCCACTGCAGCCCCCTCCCAGTCTTCTCTGTCCA<br>GGCACCAGGCCAGTGTAGCATATTGGCGCTGATGGCGCGAGGGAGGC | SEQ ID NO:<br>5655 |
| hsIGH_2078_D024_J003_IGHD6-<br>13_IGHJ3 | GCCTTGCCAGCCCGCTCAGTGGCAGTTTATTGGCGAGGCAGCTGACCC<br>CTGACTTGGACCCCTATTCCAGACACCAGACAGAGGCGCAGGCCCCCC<br>AGAACCAGGGTTGAGGGACGCCCCGTCAAAGCCAGACAAAACCAAGGG<br>GTGTTGAGCCCAGCAAGGGAAGGCCCCCAAACAGACCAGGAGGTTTCT<br>GAAGGTGTCTGTGTCACAGTGGGGTATAGCAGCAGCTTGGCAGTTTAT<br>TGGCGGTCGACGGTACTTCGATCTCTGGGGCCGTGGCACCCTGGTCAC<br>TGTCTCCTCAGGTGAGTCCCACTGCAGCCCCCTCCCAGTCTTCTCTGT<br>CCAGGCACCAGGCCATGGCAGTTTATTGGCGCTGATGGCGCGAGGGAG<br>GC | SEQ ID NO:<br>5656 |
| hsIGH_2079_D025_J003_IGHD6-<br>19_IGHJ3 | GCCTTGCCAGCCCGCTCAGCAGTCCAATATTGGCGTGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAATAT<br>TGGCGGTCGACGGTACTTCGATCTCTGGGGCCGTGGCACCCTGGTCAC<br>TGTCTCCTCAGGTGAGTCCCACTGCAGCCCCCTCCCAGTCTTCTCTGT<br>CCAGGCACCAGGCCACAGTCCAATATTGGCGCTGATGGCGCGAGGGAG<br>GC | SEQ ID NO:<br>5657 |
| hsIGH_2080_D026_J003_IGHD6-<br>25_IGHJ3 | GCCTTGCCAGCCCGCTCAGTACGTACGTATTGGCGCAGCTGGCCTCTG<br>TCTCGGACCCCCATTCCAGACACCAGACAGAGGGACAGGCCCCCCAGA<br>ACCAGTGTTGAGGGACACCCCTGTCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGTATTGG | SEQ ID NO:<br>5658 |

| | INFORMAL SEQUENCE LISTING | |
|---|---|---|
| | CGGTCGACGGTACTTCGATCTCTGGGGCCGTGGCACCCTGGTCACTGT<br>CTCCTCAGGTGAGTCCCACTGCAGCCCCTCCCAGTCTTCTCTGTCCA<br>GGCACCAGGCCATACGTACGTATTGGCGCTGATGGCGCGAGGGAGGC | |
| hsIGH_2081_D027_J003_IGHD7-<br>27_IGHJ3 | GCCTTGCCAGCCCGCTCAGAGTACCGATATTGGCGAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCTACCAGCCGCAGGGTTTTT<br>GGCTGAGCTGAGAACCACTGTGCTAACTAGTACCGATATTGGCGGTCG<br>ACGGTACTTCGATCTCTGGGGCCGTGGCACCCTGGTCACTGTCTCCTC<br>AGGTGAGTCCCACTGCAGCCCCCTCCCAGTCTTCTCTGTCCAGGCACC<br>AGGCCAAGTACCGATATTGGCGCTGATGGCGCGAGGGAGGC | SEQ ID NO:<br>5659 |
| hsIGH_2082_D001_J004_IGHD1-<br>01_IGHJ4 | GCCTTGCCAGCCCGCTCAGGACACTCTAGGCTTGAGCCCCGGTCTCTG<br>TGGGTGTTCCGCTAACTGGGGCTCCCAGTGCTCACCCCACAACTAAAG<br>CGAGCCCCAGCCTCCAGAGCCCCGAAGGAGATGCCGCCCACAAGCCC<br>AGCCCCCATCCAGGAGGCCCCAGAGCTCAGGGCGCCGGGGCAGATTCT<br>GAACAGCCCCGAGTCACGGTGGGTACAACTGGAGACACTCTAGGCTTG<br>AGTCGACAAGTGCTTGGAGCACTGGGGCCAGGGCAGCCCGGCCACCGT<br>CTCCCTGGGAACGTCACCCCTCCCTGCCTGGGTCTCAGCCCGGGGTC<br>TGTGTGGCTGGGACACTCTAGGCTTGACTGATGGCGCGAGGGAGGC | SEQ ID NO:<br>5660 |
| hsIGH_2083_D002_J004_IGHD1-<br>07_IGHJ4 | GCCTTGCCAGCCCGCTCAGTTCGGAACAGGCTTGAGGCCTCGGTCTCT<br>GTGGGTGTTCCGCTAGCTGGGGCTCACAGTGCTCACCCCACACCTAAA<br>ACGAGCCACAGCCTCAGAGCCCCTGAAGGAGACCCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACAGGCTTG<br>AGTCGACAAGTGCTTGGAGCACTGGGGCCAGGGCAGCCCGGCCACCGT<br>CTCCCTGGGAACGTCACCCCTCCCTGCCTGGGTCTCAGCCCGGGGTC<br>TGTGTGGCTGGTTCGGAACAGGCTTGACTGATGGCGCGAGGGAGGC | SEQ ID NO:<br>5661 |
| hsIGH_2084_D003_J004_IGHD1-<br>14_IGHJ4 | GCCTTGCCAGCCCGCTCAGAAGTAACGAGGCTTGAGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGAGGCTTG<br>AGTCGACAAGTGCTTGGAGCACTGGGGCCAGGGCAGCCCGGCCACCGT<br>CTCCCTGGGAACGTCACCCCTCCCTGCCTGGGTCTCAGCCCGGGGTC<br>TGTGTGGCTGGAAGTAACGAGGCTTGACTGATGGCGCGAGGGAGGC | SEQ ID NO:<br>5662 |
| hsIGH_2085_D004_J004_IGHD1-<br>20_IGHJ4 | GCCTTGCCAGCCCGCTCAGGTCTCCTAAGGCTTGAGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTAAGGCTTG<br>AGTCGACAAGTGCTTGGAGCACTGGGGCCAGGGCAGCCCGGCCACCGT<br>CTCCCTGGGAACGTCACCCCTCCCTGCCTGGGTCTCAGCCCGGGGTC<br>TGTGTGGCTGGGTCTCCTAAGGCTTGACTGATGGCGCGAGGGAGGC | SEQ ID NO:<br>5663 |
| hsIGH_2086_D005_J004_IGHD1-<br>26_IGHJ4 | GCCTTGCCAGCCCGCTCAGAGAGTGTCAGGCTTGAAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCAGGC<br>TTGAGTCGACAAGTGCTTGGAGCACTGGGGCCAGGGCAGCCCGGCCAC<br>CGTCTCCCTGGGAACGTCACCCCTCCCTGCCTGGGTCTCAGCCCGGGG<br>GTCTGTGTGGCTGGAGAGTGTCAGGCTTGACTGATGGCGCGAGGGAGG<br>C | SEQ ID NO:<br>5664 |
| hsIGH_2087_D006_J004_IGHD2-<br>02_IGHJ4 | GCCTTGCCAGCCCGCTCAGGTTCCGAAAGGCTTGAAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAAAGGCTTGAGTCGACAAGTGCTTGGAGCACTGGGGCCAGGGC<br>AGCCCGGCCACCGTCTCCCTGGGAACGTCACCCCTCCCTGCCTGGGTC<br>TCAGCCCGGGGTCTGTGTGGCTGGTTCCGAAAGGCTTGACTGATGG<br>CGCGAGGGAGGC | SEQ ID NO:<br>5665 |
| hsIGH_2088_D007_J004_IGHD2-<br>08_IGHJ4 | GCCTTGCCAGCCCGCTCAGCGTTACTTAGGCTTGAAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTAGGCTTGAGTCGACAAGTGCTTGGAGCACTGGGGCCAGGGC | SEQ ID NO:<br>5666 |

INFORMAL SEQUENCE LISTING

| | | |
|---|---|---|
| | AGCCCGGCCACCGTCTCCCTGGGAACGTCACCCCTCCCTGCCTGGGTC TCAGCCCGGGGGTCTGTGTGGCTGGCGTTACTTAGGCTTGACTGATGG CGCGAGGGAGGC | |
| hsIGH_2089_D008_J004_IGHD2-15_IGHJ4 | GCCTTGCCAGCCCGCTCAGTAGGAGACAGGCTTGAAAAGGAGGAGCCC CCTATACAGCACTGGGCTCAGAGTCCTCTCTGAGACACCCTGAGTTTC AGACAACAACCCGCTGGAATGCACAGTCTCAGCAGGAGAACAGACCAA AGCCAGCAAAAGGGACCTCGGTGACACCAGTAGGGACAGGAGGATTTT GTGGGGGCTCGTGTCACTGTGAGGATATTGTAGTGGTGGTAGCTGCTT AGGAGACAGGCTTGAGTCGACAAGTGCTTGGAGCACTGGGGCCAGGGC AGCCCGGCCACCGTCTCCCTGGGAACGTCACCCCTCCCTGCCTGGGTC TCAGCCCGGGGGTCTGTGTGGCTGGTAGGAGACAGGCTTGACTGATGG CGCGAGGGAGGC | SEQ ID NO: 5667 |
| hsIGH_2090_D009_J004_IGHD2-21_IGHJ4 | GCCTTGCCAGCCCGCTCAGGTGTCTACAGGCTTGAAGCCCCCTGTACA GCACTGGGCTCAGAGTCCTCTCTGAGACAGGCTCAGTTTCAGACAACA ACCCGCTGGAATGCACAGTCTCAGCAGGAGAGCCAGGCCAGAGCCAGC AAGAGGAGACTCGGTGACACCAGTCTCCTGTAGGGACAGGAGGATTTT GTGGGGGTTCGTGTCACTGTGAGCATATTGTGGTGGTGACTGCTGTGT CTACAGGCTTGAGTCGACAAGTGCTTGGAGCACTGGGGCCAGGGCAGC CCGGCCACCGTCTCCCTGGGAACGTCACCCCTCCCTGCCTGGGTCTCA GCCCGGGGGTCTGTGTGGCTGGGTGTCTACAGGCTTGACTGATGGCGC GAGGGAGGC | SEQ ID NO: 5668 |
| hsIGH_2091_D010_J004_IGHD3-03_IGHJ4 | GCCTTGCCAGCCCGCTCAGTGCTACACAGGCTTGAGTGGGCACGGACA CTGTCCACCTAAGCCAGGGGCAGACCCGAGTGTCCCCGCAGTAGACCT GAGAGCGCTGGGCCCACAGCCTCCCCTCGGTGCCCTGCTACCTCCTCA GGTCAGCCCTGGACATCCCGGGTTTCCCCAGGCTGGCGGTAGGTTTGG GGTGAGGTCTGTGTCACTGTGGTATTACGATTTTTGGAGTGGTTATTT GCTACACAGGCTTGAGTCGACAAGTGCTTGGAGCACTGGGGCCAGGGC AGCCCGGCCACCGTCTCCCTGGGAACGTCACCCCTCCCTGCCTGGGTC TCAGCCCGGGGGTCTGTGTGGCTGGTGCTACACAGGCTTGACTGATGG CGCGAGGGAGGC | SEQ ID NO: 5669 |
| hsIGH_2092_D011_J004_IGHD3-09_IGHJ4 | GCCTTGCCAGCCCGCTCAGAACTGCCAAGGCTTGATGGGCACGGACAC TATCCACATAAGCGAGGGATAGACCCGAGTGTCCCCACAGCAGACCTG AGAGCGCTGGGCCCACAGCCTCCCCTCAGAGCCCTGCTGCCTCCTCCG GTCAGCCCTGGACATCCCAGGTTTCCCCAGGCCTGCCGGTAGGTTTAG AATGAGGTCTGTGTCACTGTGGTATTACGATATTTTGACTGGTTATTA ACTGCCAAGGCTTGAGTCGACAAGTGCTTGGAGCACTGGGGCCAGGGC AGCCCGGCCACCGTCTCCCTGGGAACGTCACCCCTCCCTGCCTGGGTC TCAGCCCGGGGGTCTGTGTGGCTGGAACTGCCAAGGCTTGACTGATGG CGCGAGGGAGGC | SEQ ID NO: 5670 |
| hsIGH_2093_D012_J004_IGHD3-10_IGHJ4 | GCCTTGCCAGCCCGCTCAGTTGGACTGAGGCTTGACGATATTTTGACT GGTTATTATAACCACAGTGTCACAGAGTCCATCAAAAACCCATGCCTG GAAGCTTCCCGCCACAGCCCTCCCCATGGGGCCCTGCTGCCTCCTCAG GTCAGCCCCGGACATCCCGGGTTTCCCCAGGCTGGGCGGTAGGTTTGG GGTGAGGTCTGTGTCACTGTGGTATTACTATGGTTCGGGGAGTTATTT TGGACTGAGGCTTGAGTCGACAAGTGCTTGGAGCACTGGGGCCAGGGC AGCCCGGCCACCGTCTCCCTGGGAACGTCACCCCTCCCTGCCTGGGTC TCAGCCCGGGGGTCTGTGTGGCTGGTTGGACTGAGGCTTGACTGATGG CGCGAGGGAGGC | SEQ ID NO: 5671 |
| hsIGH_2094_D013_J004_IGHD3-16_IGHJ4 | GCCTTGCCAGCCCGCTCAGGTAGACACAGGCTTGATGGACGCGGACAC TATCCACATAAGCGAGGGACAGACCCGAGTGTTCCTGCAGTAGACCTG AGAGCGCTGGGCCCACAGCCTCCCCTCGGTGCCCTGCTGCCTCCTCAG GTCAGCCCTGGACATCCCGGGTTTCCCCAGGCCAGATGGTAGGTTTGA AGTGAGGTCTGTGTCACTGTGGTATTATGATTACGTTTGGGGGAGTTA TCGTTGTAGACACAGGCTTGAGTCGACAAGTGCTTGGAGCACTGGGGC CAGGGCAGCCCGGCCACCGTCTCCCTGGGAACGTCACCCCTCCCTGCC TGGGTCTCAGCCCGGGGGTCTGTGTGGCTGGGTAGACACAGGCTTGAC TGATGGCGCGAGGGAGGC | SEQ ID NO: 5672 |
| hsIGH_2095_D014_J004_IGHD3-22_IGHJ4 | GCCTTGCCAGCCCGCTCAGCACTGTACAGGCTTGATGGGCATGGACAG TGTCCACCTAAGCGAGGGACAGACCCGAGTGTCCCTGCAGTAGACCTG AGAGCGCTGGGCCCACAGCCTCCCCTCGGGGCCCTGCTGCCTCCTCAG GTCAGCCCTGGACATCCCGGGTTTCCCCAGGCTGGCGGTAGGTTTGA AGTGAGGTCTGTGTCACTGTGGTATTACTATGATAGTAGTGGTTATTC ACTGTACAGGCTTGAGTCGACAAGTGCTTGGAGCACTGGGGCCAGGGC AGCCCGGCCACCGTCTCCCTGGGAACGTCACCCCTCCCTGCCTGGGTC TCAGCCCGGGGGTCTGTGTGGCTGGCACTGTACAGGCTTGACTGATGG CGCGAGGGAGGC | SEQ ID NO: 5673 |
| hsIGH_2096_D015_J004_IGHD4-04_IGHJ4 | GCCTTGCCAGCCCGCTCAGGATGATCCAGGCTTGACAAGGGTGAGTCA GACCCTCCTGCCCTCGATGGCAGGCGGAGAAGATTCAGAAAGGTCTGA GATCCCCAGGACGCAGCACCACTGTCAATGGGGGCCCCAGACGCCTGG | SEQ ID NO: 5674 |

| INFORMAL SEQUENCE LISTING | | |
|---|---|---|
| | ACCAGGGCCTGCGTGGGAAAGGCCTCTGGGCACACTCAGGGGCTTTTT<br>GTGAAGGGTCCTCCTACTGTGTGACTACAGTAGATGATCCAGGCTTGA<br>GTCGACAAGTGCTTGGAGCACTGGGGCCAGGGCAGCCCGGCCACCGTC<br>TCCCTGGGAACGTCACCCCTCCCTGCCTGGGTCTCAGCCCGGGGGTCT<br>GTGTGGCTGGGATGATCCAGGCTTGACTGATGGCGCGAGGGAGGC | |
| hsIGH_2097_D016_J004_IGHD4-<br>11_IGHJ4 | GCCTTGCCAGCCCGCTCAGCGCCAATAAGGCTTGATGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACAGTACGCCAATAAGGCTTGA<br>GTCGACAAGTGCTTGGAGCACTGGGGCCAGGGCAGCCCGGCCACCGTC<br>TCCCTGGGAACGTCACCCCTCCCTGCCTGGGTCTCAGCCCGGGGGTCT<br>GTGTGGCTGGCGCCAATAAGGCTTGACTGATGGCGCGAGGGAGGC | SEQ ID NO:<br>5675 |
| hsIGH_2098_D017_J004_IGHD4-<br>17_IGHJ4 | GCCTTGCCAGCCCGCTCAGTCAAGCCTAGGCTTGAGGAGGGTGAGTCA<br>GACCCACCTGCCCTCGATGGCAGGCGGGGAAGATTCAGAAAGGCCTGA<br>GATCCCCAGGACGCAGCACCACTGTCAATGGGGGCCCCAGACGCCTGG<br>ACCAGGGCCTGCGTGGGAAAGGCCGCTGGGCACACTCAGGGGCTTTTT<br>GTGAAGGCCCCTCCTACTGTGTGACTACGGTGTCAAGCCTAGGCTTGA<br>GTCGACAAGTGCTTGGAGCACTGGGGCCAGGGCAGCCCGGCCACCGTC<br>TCCCTGGGAACGTCACCCCTCCCTGCCTGGGTCTCAGCCCGGGGGTCT<br>GTGTGGCTGGTCAAGCCTAGGCTTGACTGATGGCGCGAGGGAGGC | SEQ ID NO:<br>5676 |
| hsIGH_2099_D018_J004_IGHD4-<br>23_IGHJ4 | GCCTTGCCAGCCCGCTCAGACGTGTGTAGGCTTGAGGAGGGTGAGTCA<br>GACCCACCTGCCCTCAATGGCAGGCGGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTGTAGGCT<br>TGAGTCGACAAGTGCTTGGAGCACTGGGGCCAGGGCAGCCCGGCCACC<br>GTCTCCCTGGGAACGTCACCCCTCCCTGCCTGGGTCTCAGCCCGGGGG<br>TCTGTGTGGCTGGACGTGTGTAGGCTTGACTGATGGCGCGAGGGAGGC | SEQ ID NO:<br>5677 |
| hsIGH_2100_D019_J004_IGHD5-<br>05_IGHJ4 | GCCTTGCCAGCCCGCTCAGTCCGTCTAAGGCTTGAAGAGGCCTCTCCA<br>GGGGGACACTGTGCATGTCTGGTCCCTGAGCAGCCCCCCATGTCCCCA<br>GTCCTGGGGGGCCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTCCGTCTAAGGC<br>TTGAGTCGACAAGTGCTTGGAGCACTGGGGCCAGGGCAGCCCGGCCAC<br>CGTCTCCCTGGGAACGTCACCCCTCCCTGCCTGGGTCTCAGCCCGGGG<br>GTCTGTGTGGCTGGTCCGTCTAAGGCTTGACTGATGGCGCGAGGGAGG<br>C | SEQ ID NO:<br>5678 |
| hsIGH_2101_D020_J004_IGHD5-<br>12_IGHJ4 | GCCTTGCCAGCCCGCTCAGAAGAGCTGAGGCTTGAGCAGAGGCCTCTC<br>CAGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATATAGTGGCTACGAAGAGCTGA<br>GGCTTGAGTCGACAAGTGCTTGGAGCACTGGGGCCAGGGCAGCCCGGC<br>CACCGTCTCCCTGGGAACGTCACCCCTCCCTGCCTGGGTCTCAGCCCG<br>GGGGTCTGTGTGGCTGGAAGAGCTGAGGCTTGACTGATGGCGCGAGGG<br>AGGC | SEQ ID NO:<br>5679 |
| hsIGH_2102_D021_J004_IGHD5-<br>18_IGHJ4 | GCCTTGCCAGCCCGCTCAGTATCGCTCAGGCTTGAGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCAGGC<br>TTGAGTCGACAAGTGCTTGGAGCACTGGGGCCAGGGCAGCCCGGCCAC<br>CGTCTCCCTGGGAACGTCACCCCTCCCTGCCTGGGTCTCAGCCCGGGG<br>GTCTGTGTGGCTGGTATCGCTCAGGCTTGACTGATGGCGCGAGGGAGG<br>C | SEQ ID NO:<br>5680 |
| hsIGH_2103_D022_J004_IGHD5-<br>24_IGHJ4 | GCCTTGCCAGCCCGCTCAGTCAGATGCAGGCTTGAGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCAGGCCGTGGTAGAGATGGCTACATCAGATGCAGGC<br>TTGAGTCGACAAGTGCTTGGAGCACTGGGGCCAGGGCAGCCCGGCCAC<br>CGTCTCCCTGGGAACGTCACCCCTCCCTGCCTGGGTCTCAGCCCGGGG<br>GTCTGTGTGGCTGGTCAGATGCAGGCTTGACTGATGGCGCGAGGGAGG<br>C | SEQ ID NO:<br>5681 |
| hsIGH_2104_D023_J004_IGHD6-<br>06_IGHJ4 | GCCTTGCCAGCCCGCTCAGGTGTAGCAAGGCTTGAAGGCAGCTGACTC<br>CTGACTTGGACGCCTATTCCAGACACCAGACAGAGGGGCAGGCCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT | SEQ ID NO:<br>5682 |

| INFORMAL SEQUENCE LISTING | | |
|---|---|---|
| | GAAGGTGTCTGTGTCACAGTGGAGTATAGCAGCTGTGTAGCAAGGCTT GAGTCGACAAGTGCTTGGAGCACTGGGGCCAGGGCAGCCCGGCCACCG TCTCCCTGGGAACGTCACCCCTCCCTGCCTGGGTCTCAGCCCGGGGT CTGTGTGGCTGGGTGTAGCAAGGCTTGACTGATGGCGCGAGGGAGGC | |
| hsIGH_2105_D024_J004_IGHD6-13_IGHJ4 | GCCTTGCCAGCCCGCTCAGTGGCAGTTAGGCTTGAAGGCAGCTGACCC CTGACTTGGACCCCTATTCCAGACACCAGACAGAGGCGCAGGCCCCC AGAACCAGGGTTGAGGGACGCCCCGTCAAAGCCAGACAAAACCAAGGG GTGTTGAGCCCAGCAAGGGAAGGCCCCCAAACAGACCAGGAGGTTTCT GAAGGTGTCTGTGTCACAGTGGGGTATAGCAGCAGCTTGGCAGTTAGG CTTGAGTCGACAAGTGCTTGGAGCACTGGGGCCAGGGCAGCCCGGCCA CCGTCTCCCTGGGAACGTCACCCCTCCCTGCCTGGGTCTCAGCCCGGG GGTCTGTGTGGCTGGTGGCAGTTAGGCTTGACTGATGGCGCGAGGGAG GC | SEQ ID NO: 5683 |
| hsIGH_2106_D025_J004_IGHD6-19_IGHJ4 | GCCTTGCCAGCCCGCTCAGCAGTCCAAAGGCTTGATGAGGTAGCTGGC CTCTGTCTCGGACCCCACTCCAGACACCAGACAGAGGGGCAGGCCCCC CAAAACCAGGGTTGAGGGATGATCCGTCAAGGCAGACAAGACCAAGGG GCACTGACCCCAGCAAGGGAAGGCTCCCAAACAGACGAGGAGGTTTCT GAAGCTGTCTGTATCACAGTGGGGTATAGCAGTGGCTCAGTCCAAAGG CTTGAGTCGACAAGTGCTTGGAGCACTGGGGCCAGGGCAGCCCGGCCA CCGTCTCCCTGGGAACGTCACCCCTCCCTGCCTGGGTCTCAGCCCGGG GGTCTGTGTGGCTGGCAGTCCAAAGGCTTGACTGATGGCGCGAGGGAG GC | SEQ ID NO: 5684 |
| hsIGH_2107_D026_J004_IGHD6-25_IGHJ4 | GCCTTGCCAGCCCGCTCAGTACGTACGAGGCTTGACAGCTGGCCTCTG TCTCGGACCCCCATTCCAGACACCAGACAGAGGGACAGGCCCCCCAGA ACCAGTGTTGAGGGACACCCCTGTCCAGGGCAGCCAAGTCCAAGAGGC GCGCTGAGCCCAGCAAGGGAAGGCCCCCAAACAAACCAGGAGGTTTCT GAAGCTGTCTGTGTCACAGTCGGGTATAGCAGCGTACGTACGAGGCTT GAGTCGACAAGTGCTTGGAGCACTGGGGCCAGGGCAGCCCGGCCACCG TCTCCCTGGGAACGTCACCCCTCCCTGCCTGGGTCTCAGCCCGGGGGT CTGTGTGGCTGGTACGTACGAGGCTTGACTGATGGCGCGAGGGAGGC | SEQ ID NO: 5685 |
| hsIGH_2108_D027_J004_IGHD7-27_IGHJ4 | GCCTTGCCAGCCCGCTCAGAGTACCGAAGGCTTGAAGGGTTGAGGGCT GGGGTCTCCCACGTGTTTTGGGGCTAACAGCGGAAGGGAGAGCACTGG CAAAGGTGCTGGGGGTCCCCTGAACCCGACCCGCCCTGAGACCGCAGC CACATCAGCCCCCAGCCCCACAGGCCCCCTACCAGCCGCAGGGTTTTT GGCTGAGCTGAGAACCACTGTGCTAACTAGTACCGAAGGCTTGAGTCG ACAAGTGCTTGGAGCACTGGGGCCAGGGCAGCCCGGCCACCGTCTCCC TGGGAACGTCACCCCTCCCTGCCTGGGTCTCAGCCCGGGGTCTGTGT GGCTGGAGTACCGAAGGCTTGACTGATGGCGCGAGGGAGGC | SEQ ID NO: 5686 |
| hsIGH_2109_D001_J005_IGHD1-01_IGHJ5 | GCCTTGCCAGCCCGCTCAGGACACTCTACACACGTGCCCCGGTCTCTG TGGGTGTTCCGCTAACTGGGGCTCCCAGTGCTCACCCCACAACTAAAG CGAGCCCCAGCCTCCAGAGCCCCCGAAGGAGATGCCGCCCACAAGCCC AGCCCCCATCCAGGAGGCCCCAGAGCTCAGGGCGCCGGGGCAGATTCT GAACAGCCCCGAGTCACGGTGGGTACAACTGGAGACACTCTACACACG TGTCGACCTTTTGATATCTGGGGCCAAGGGACAATGGTCACCGTCTCT TCAGGTAAGATGGCTTTCCTTCTGCCTCCTTTCTCTGGGCCCAGCGTC CTCTGTCCTGGGACACTCTACACACGTCTGATGGCGCGAGGGAGGC | SEQ ID NO: 5687 |
| hsIGH_2110_D002_J005_IGHD1-07_IGHJ5 | GCCTTGCCAGCCCGCTCAGTTCGGAACACACACGTGGCCTCGGTCTCT GTGGGTGTTCCGCTAGCTGGGGCTCACAGTGCTCACCCCACACCTAAA ACGAGCCACAGCCTCAGAGCCCCTGAAGGAGACCCCGCCCACAAGCCC AGCCCCCACCCAGGAGGCCCCAGAGCACAGGGCGCCCCGTCGGATTCT GAACAGCCCCGAGTCACAGTGGGTATAACTGGATTCGGAACACACACG TGTCGACCTTTTGATATCTGGGGCCAAGGGACAATGGTCACCGTCTCT TCAGGTAAGATGGCTTTCCTTCTGCCTCCTTTCTCTGGGCCCAGCGTC CTCTGTCCTGGTTCGGAACACACACGTCTGATGGCGCGAGGGAGGC | SEQ ID NO: 5688 |
| hsIGH_2111_D003_J005_IGHD1-14_IGHJ5 | GCCTTGCCAGCCCGCTCAGAAGTAACGACACACGTGGCCTCGGTCTCT GTGGGTGTTCCGCTAGCTGGGGCTCACAGTGCTCACCCCACACCTAAA ATGAGCCACAGCCTCCGGAGCCCCCGCAGAGACCCCGCCCACAAGCCC AGCCCCCACCCAGGAGGCCCCAGAGCTCAGGGCGCCCCGTCGGATTCC GAACAGCCCCGAGTCACAGCGGGTATAACCGGAAAGTAACGACACACG TGTCGACCTTTTGATATCTGGGGCCAAGGGACAATGGTCACCGTCTCT TCAGGTAAGATGGCTTTCCTTCTGCCTCCTTTCTCTGGGCCCAGCGTC CTCTGTCCTGGAAGTAACGACACACGTCTGATGGCGCGAGGGAGGC | SEQ ID NO: 5689 |
| hsIGH_2112_D004_J005_IGHD1-20_IGHJ5 | GCCTTGCCAGCCCGCTCAGGTCTCCTAACACACGTGTCTCTGTGGGTG TTCCGCTAGCTGGGGCCCCAGTGCTCACCCCACACCTAAAGCGAGCC CCAGCCTCCAGAGCCCCCTAAGCATTCCCCGCCCAGCAGCCCAGCCCC TGCCCCACCCAGGAGGCCCCAGAGCTCAGGGCGCCTGGTCGGATTCT GAACAGCCCCGAGTCACAGTGGGTATAACTGGAGTCTCCTAACACACG | SEQ ID NO: 5690 |

| | INFORMAL SEQUENCE LISTING | |
|---|---|---|
| | TGTCGACCTTTTGATATCTGGGGCCAAGGGACAATGGTCACCGTCTCT<br>TCAGGTAAGATGGCTTTCCTTCTGCCTCCTTTCTCTGGGCCCAGCGTC<br>CTCTGTCCTGGGTCTCCTAACACACGTCTGATGGCGCGAGGGAGGC | |
| hsIGH_2113_D005_J005_IGHD1-26_IGHJ5 | GCCTTGCCAGCCCGCTCAGAGAGTGTCACACACGTAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCACAC<br>ACGTGTCGACCTTTTGATATCTGGGGCCAAGGGACAATGGTCACCGTC<br>TCTTCAGGTAAGATGGCTTTCCTTCTGCCTCCTTTCTCTGGGCCCAGC<br>GTCCTCTGTCCTGGAGAGTGTCACACACGTCTGATGGCGCGAGGGAGG<br>C | SEQ ID NO:<br>5691 |
| hsIGH_2114_D006_J005_IGHD2-02_IGHJ5 | GCCTTGCCAGCCCGCTCAGGTTCCGAAACACACGTAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAAACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGGTTCCGAAACACACGTCTGATGG<br>CGCGAGGGAGGC | SEQ ID NO:<br>5692 |
| hsIGH_2115_D007_J005_IGHD2-08_IGHJ5 | GCCTTGCCAGCCCGCTCAGCGTTACTTACACACGTAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGCGTTACTTACACACGTCTGATGG<br>CGCGAGGGAGGC | SEQ ID NO:<br>5693 |
| hsIGH_2116_D008_J005_IGHD2-15_IGHJ5 | GCCTTGCCAGCCCGCTCAGTAGGAGACACACACGTAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGTAGGAGACACACACGTCTGATGG<br>CGCGAGGGAGGC | SEQ ID NO:<br>5694 |
| hsIGH_2117_D009_J005_IGHD2-21_IGHJ5 | GCCTTGCCAGCCCGCTCAGGTGTCTACACACACGTAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT<br>CTACACACACGTGTCGACCTTTTGATATCTGGGGCCAAGGGACAATGG<br>TCACCGTCTCTTCAGGTAAGATGGCTTTCCTTCTGCCTCCTTTCTCTG<br>GGCCCAGCGTCCTCTGTCCTGGGTGTCTACACACACGTCTGATGGCGC<br>GAGGGAGGC | SEQ ID NO:<br>5695 |
| hsIGH_2118_D010_J005_IGHD3-03_IGHJ5 | GCCTTGCCAGCCCGCTCAGTGCTACACACACGTGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGTGCTACACACACGTCTGATGG<br>CGCGAGGGAGGC | SEQ ID NO:<br>5696 |
| hsIGH_2119_D011_J005_IGHD3-09_IGHJ5 | GCCTTGCCAGCCCGCTCAGAACTGCCAACACACGTTGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCAGGTTTCCCCAGGCCTGCCGGTAGGTTTAG<br>AATGAGGTCTGTGTCACTGTGGTATTACGATATTTTGACTGGTTATTA<br>ACTGCCAACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGAACTGCCAACACACGTCTGATGG<br>CGCGAGGGAGGC | SEQ ID NO:<br>5697 |
| hsIGH_2120_D012_J005_IGHD3-10_IGHJ5 | GCCTTGCCAGCCCGCTCAGTTGGACTGACACACGTCGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG | SEQ ID NO:<br>5698 |

| | INFORMAL SEQUENCE LISTING | |
|---|---|---|
| | GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGTTGGACTGACACACGTCTGATGG<br>CGCGAGGGAGGC | |
| hsIGH_2121_D013_J005_IGHD3-<br>16_IGHJ5 | GCCTTGCCAGCCCGCTCAGGTAGACACACACACGTTGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACACACGTGTCGACCTTTTGATATCTGGGGCCAAG<br>GGACAATGGTCACCGTCTCTTCAGGTAAGATGGCTTTCCTTCTGCCTC<br>CTTTCTCTGGGCCCAGCGTCCTCTGTCCTGGGTAGACACACACGTC<br>TGATGGCGCGAGGGAGGC | SEQ ID NO:<br>5699 |
| hsIGH_2122_D014_J005_IGHD3-<br>22_IGHJ5 | GCCTTGCCAGCCCGCTCAGCACTGTACACACACGTTGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA<br>AGTGAGGTCTGTGTCACTGTGGTATTACTATGATAGTAGTGGTTATTC<br>ACTGTACACACGTGTCGACCTTTTGATATCTGGGGCCAAGGGACAA<br>TGGTCACCGTCTCTTCAGGTAAGATGGCTTTCCTTCTGCCTCCTTTCT<br>CTGGGCCCAGCGTCCTCTGTCCTGGCACTGTACACACACGTCTGATGG<br>CGCGAGGGAGGC | SEQ ID NO:<br>5700 |
| hsIGH_2123_D015_J005_IGHD4-<br>04_IGHJ5 | GCCTTGCCAGCCCGCTCAGGATGATCCACACACGTCAAGGGTGAGTCA<br>GACCCTCCTGCCCTCGATGGCAGGCGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCACACACGT<br>GTCGACCTTTTGATATCTGGGGCCAAGGGACAATGGTCACCGTCTCTT<br>CAGGTAAGATGGCTTTCCTTCTGCCTCCTTTCTCTGGGCCCAGCGTCC<br>TCTGTCCTGGGATGATCCACACACGTCTGATGGCGCGAGGGAGGC | SEQ ID NO:<br>5701 |
| hsIGH_2124_D016_J005_IGHD4-<br>11_IGHJ5 | GCCTTGCCAGCCCGCTCAGCGCCAATAACACACGTTGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACAGTACGCCAATAACACACGT<br>GTCGACCTTTTGATATCTGGGGCCAAGGGACAATGGTCACCGTCTCTT<br>CAGGTAAGATGGCTTTCCTTCTGCCTCCTTTCTCTGGGCCCAGCGTCC<br>TCTGTCCTGGCGCCAATAACACACGTCTGATGGCGCGAGGGAGGC | SEQ ID NO:<br>5702 |
| hsIGH_2125_D017_J005_IGHD4-<br>17_IGHJ5 | GCCTTGCCAGCCCGCTCAGTCAAGCCTACACACGTGGAGGGTGAGTCA<br>GACCCACCTGCCCTCGATGGCAGGCGGGAAGATTCAGAAAGGCCTGA<br>GATCCCCAGGACGCAGCACCACTGTCAATGGGGGCCCCAGACGCCTGG<br>ACCAGGGCCTGCGTGGGAAAGGCCGCTGGGCACACTCAGGGGCTTTTT<br>GTGAAGGCCCCTCCTACTGTGTGACTACGGTGTCAAGCCTACACACGT<br>GTCGACCTTTTGATATCTGGGGCCAAGGGACAATGGTCACCGTCTCTT<br>CAGGTAAGATGGCTTTCCTTCTGCCTCCTTTCTCTGGGCCCAGCGTCC<br>TCTGTCCTGGTCAAGCCTACACACGTCTGATGGCGCGAGGGAGGC | SEQ ID NO:<br>5703 |
| hsIGH_2126_D018_J005_IGHD4-<br>23_IGHJ5 | GCCTTGCCAGCCCGCTCAGACGTGTGTACACACGTGGAGGGTGAGTCA<br>GACCCACCTGCCCTCAATGGCAGGCGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTACACA<br>CGTGTCGACCTTTTGATATCTGGGGCCAAGGGACAATGGTCACCGTCT<br>CTTCAGGTAAGATGGCTTTCCTTCTGCCTCCTTTCTCTGGGCCCAGCG<br>TCCTCTGTCCTGGACGTGTGTACACACGTCTGATGGCGCGAGGGAGGC | SEQ ID NO:<br>5704 |
| hsIGH_2127_D019_J005_IGHD5-<br>05_IGHJ5 | GCCTTGCCAGCCCGCTCAGTCCGTCTAACACACGTAGAGGCCTCTCCA<br>GGGGGACACTGTGCATGTCTGGTCCCTGAGCAGCCCCCATGTCCCCA<br>GTCCTGGGGGCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGTGTCAGACTGTGGTGGATACAGCTATGTCCGTCTAACAC<br>ACGTGTCGACCTTTTGATATCTGGGGCCAAGGGACAATGGTCACCGTC<br>TCTTCAGGTAAGATGGCTTTCCTTCTGCCTCCTTTCTCTGGGCCCAGC<br>GTCCTCTGTCCTGGTCCGTCTAACACACGTCTGATGGCGCGAGGGAGG<br>C | SEQ ID NO:<br>5705 |
| hsIGH_2128_D020_J005_IGHD5-<br>12_IGHJ5 | GCCTTGCCAGCCCGCTCAGAAGAGCTGACACACGTGCAGAGGCCTCTC<br>CAGGGAGACACTGTGCATGTCTGGTACCTAAGCAGCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT | SEQ ID NO:<br>5706 |

| | INFORMAL SEQUENCE LISTING | |
|---|---|---|
| | GTCAGGCGATGTCAGACTGTGGTGGATATAGTGGCTACGAAGAGCTGA<br>CACACGTGTCGACCTTTTGATATCTGGGGCCAAGGGACAATGGTCACC<br>GTCTCTTCAGGTAAGATGGCTTTCCTTCTGCCTCCTTTCTCTGGGCCC<br>AGCGTCCTCTGTCCTGGAAGAGCTGACACACGTCTGATGGCGCGAGGG<br>AGGC | |
| hsIGH_2129_D021_J005_IGHD5-<br>18_IGHJ5 | GCCTTGCCAGCCCGCTCAGTATCGCTCACACACGTGCAGAGGCCTCTC<br>CAGGGGGACACTGTGCATGTCTGGTCCCTGAGCAGCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCACAC<br>ACGTGTCGACCTTTTGATATCTGGGGCCAAGGGACAATGGTCACCGTC<br>TCTTCAGGTAAGATGGCTTTCCTTCTGCCTCCTTTCTCTGGGCCCAGC<br>GTCCTCTGTCCTGGTATCGCTCACACACGTCTGATGGCGCGAGGGAGG<br>C | SEQ ID NO:<br>5707 |
| hsIGH_2130_D022_J005_IGHD5-<br>24_IGHJ5 | GCCTTGCCAGCCCGCTCAGTCAGATGCACACACGTGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCACAC<br>ACGTGTCGACCTTTTGATATCTGGGGCCAAGGGACAATGGTCACCGTC<br>TCTTCAGGTAAGATGGCTTTCCTTCTGCCTCCTTTCTCTGGGCCCAGC<br>GTCCTCTGTCCTGGTCAGATGCACACACGTCTGATGGCGCGAGGGAGG<br>C | SEQ ID NO:<br>5708 |
| hsIGH_2131_D023_J005_IGHD6-<br>06_IGHJ5 | GCCTTGCCAGCCCGCTCAGGTGTAGCAACACACGTAGGCAGCTGACTC<br>CTGACTTGGACGCCTATTCCAGACACCAGACAGAGGGGCAGGCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCAACACAC<br>GTGTCGACCTTTTGATATCTGGGGCCAAGGGACAATGGTCACCGTCTC<br>TTCAGGTAAGATGGCTTTCCTTCTGCCTCCTTTCTCTGGGCCCAGCGT<br>CCTCTGTCCTGGGTGTAGCAACACACGTCTGATGGCGCGAGGGAGGC | SEQ ID NO:<br>5709 |
| hsIGH_2132_D024_J005_IGHD6-<br>13_IGHJ5 | GCCTTGCCAGCCCGCTCAGTGGCAGTTACACACGTAGGCAGCTGACCC<br>CTGACTTGGACCCCTATTCCAGACACCAGACAGAGGCGCAGGCCCCC<br>AGAACCAGGGTTGAGGGACGCCCCGTCAAAGCCAGACAAAACCAAGGG<br>GTGTTGAGCCCAGCAAGGGAAGGCCCCCAAACAGACCAGGAGGTTTCT<br>GAAGGTGTCTGTGTCACAGTGGGGTATAGCAGCAGCTTGGCAGTTACA<br>CACGTGTCGACCTTTTGATATCTGGGGCCAAGGGACAATGGTCACCGT<br>CTCTTCAGGTAAGATGGCTTTCCTTCTGCCTCCTTTCTCTGGGCCCAG<br>CGTCCTCTGTCCTGGTGGCAGTTACACACGTCTGATGGCGCGAGGGAG<br>GC | SEQ ID NO:<br>5710 |
| hsIGH_2133_D025_J005_IGHD6-<br>19_IGHJ5 | GCCTTGCCAGCCCGCTCAGCAGTCCAAACACACGTTGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAAACA<br>CACGTGTCGACCTTTTGATATCTGGGGCCAAGGGACAATGGTCACCGT<br>CTCTTCAGGTAAGATGGCTTTCCTTCTGCCTCCTTTCTCTGGGCCCAG<br>CGTCCTCTGTCCTGGCAGTCCAAACACACGTCTGATGGCGCGAGGGAG<br>GC | SEQ ID NO:<br>5711 |
| hsIGH_2134_D026_J005_IGHD6-<br>25_IGHJ5 | GCCTTGCCAGCCCGCTCAGTACGTACGACACACGTCAGCTGGCCTCTG<br>TCTCGGACCCCCATTCCAGACACCAGACAGAGGGACAGGCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGACACAC<br>GTGTCGACCTTTTGATATCTGGGGCCAAGGGACAATGGTCACCGTCTC<br>TTCAGGTAAGATGGCTTTCCTTCTGCCTCCTTTCTCTGGGCCCAGCGT<br>CCTCTGTCCTGGTACGTACGACACACGTCTGATGGCGCGAGGGAGGC | SEQ ID NO:<br>5712 |
| hsIGH_2135_D027_J005_IGHD7-<br>27_IGHJ5 | GCCTTGCCAGCCCGCTCAGAGTACCGAACACACGTAGGGTTGAGGGCT<br>GGGGTCTCCCACGTGTTTTGGGGCTAACAGCGGAAGGGAGGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT<br>GGCTGAGCTGAGAACCACTGTGCTAACTAGTACCGAACACACGTGTCG<br>ACCTTTTGATATCTGGGGCCAAGGGACAATGGTCACCGTCTCTTCAGG<br>TAAGATGGCTTTCCTTCTGCCTCCTTTCTCTGGGCCCAGCGTCCTCTG<br>TCCTGGAGTACCGAACACACGTCTGATGGCGCGAGGGAGGC | SEQ ID NO:<br>5713 |
| hsIGH_2136_D001_J006_IGHD1-<br>01_IGHJ6 | GCCTTGCCAGCCCGCTCAGGACACTTTAGACGGAGCCCCGGTCTCTG<br>TGGGTGTTCCGCTAACTGGGGCTCCCAGTGCTCACCCCACAACTAAAG<br>CGAGCCCCAGCCTCCAGAGCCCCGAAGGAGATGCCGCCCACAAGCCC<br>AGCCCCCATCCAGGAGGCCCCAGAGCTCAGGGCGCCGGGGCAGATTCT | SEQ ID NO:<br>5714 |

| | INFORMAL SEQUENCE LISTING | |
|---|---|---|
| | GAACAGCCCCGAGTCACGGTGGGTACAACTGGAGACACTCTTAGACGG<br>AGTCGACAGTTGGACTTCCCAGGCCGACAGTGGTCTGGCTTCTGAGGG<br>GTCAGGCCAGAATGTGGGGTACGTGGGAGGCCAGCAGAGGGTTCCATG<br>AGAAGGGCAGGGACACTCTTAGACGGACTGATGGCGCGAGGGAGGC | |
| hsIGH_2137_D002_J006_IGHD1-<br>07_IGHJ6 | GCCTTGCCAGCCCGCTCAGTTCGGAACTAGACGGAGGCCTCGGTCTCT<br>GTGGGTGTTCCGCTAGCTGGGGCTCACAGTGCTCACCCCACACCTAAA<br>ACGAGCCACAGCCTCAGAGCCCCTGAAGGAGACCCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACTAGACGG<br>AGTCGACAGTTGGACTTCCCAGGCCGACAGTGGTCTGGCTTCTGAGGG<br>GTCAGGCCAGAATGTGGGGTACGTGGGAGGCCAGCAGAGGGTTCCATG<br>AGAAGGGCAGGTTCGGAACTAGACGGACTGATGGCGCGAGGGAGGC | SEQ ID NO:<br>5715 |
| hsIGH_2138_D003_J006_IGHD1-<br>14_IGHJ6 | GCCTTGCCAGCCCGCTCAGAAGTAACGTAGACGGAGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGTAGACGG<br>AGTCGACAGTTGGACTTCCCAGGCCGACAGTGGTCTGGCTTCTGAGGG<br>GTCAGGCCAGAATGTGGGGTACGTGGGAGGCCAGCAGAGGGTTCCATG<br>AGAAGGGCAGGAAGTAACGTAGACGGACTGATGGCGCGAGGGAGGC | SEQ ID NO:<br>5716 |
| hsIGH_2139_D004_J006_IGHD1-<br>20_IGHJ6 | GCCTTGCCAGCCCGCTCAGGTCTCCTATAGACGGAGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTATAGACGG<br>AGTCGACAGTTGGACTTCCCAGGCCGACAGTGGTCTGGCTTCTGAGGG<br>GTCAGGCCAGAATGTGGGGTACGTGGGAGGCCAGCAGAGGGTTCCATG<br>AGAAGGGCAGGGTCTCCTATAGACGGACTGATGGCGCGAGGGAGGC | SEQ ID NO:<br>5717 |
| hsIGH_2140_D005_J006_IGHD1-<br>26_IGHJ6 | GCCTTGCCAGCCCGCTCAGAGAGTGTCTAGACGGAAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCTAGA<br>CGGAGTCGACAGTTGGACTTCCCAGGCCGACAGTGGTCTGGCTTCTGA<br>GGGGTCAGGCCAGAATGTGGGGTACGTGGGAGGCCAGCAGAGGGTTCC<br>ATGAGAAGGGCAGGAGAGTGTCTAGACGGACTGATGGCGCGAGGGAGG<br>C | SEQ ID NO:<br>5718 |
| hsIGH_2141_D006_J006_IGHD2-<br>02_IGHJ6 | GCCTTGCCAGCCCGCTCAGGTTCCGAATAGACGGAAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAATAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGGTTCCGAATAGACGGACTGATGG<br>CGCGAGGGAGGC | SEQ ID NO:<br>5719 |
| hsIGH_2142_D007_J006_IGHD2-<br>08_IGHJ6 | GCCTTGCCAGCCCGCTCAGCGTTACTTTAGACGGAAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTTAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGCGTTACTTTAGACGGACTGATGG<br>CGCGAGGGAGGC | SEQ ID NO:<br>5720 |
| hsIGH_2143_D008_J006_IGHD2-<br>15_IGHJ6 | GCCTTGCCAGCCCGCTCAGTAGGAGACTAGACGGAAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACTAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGTAGGAGACTAGACGGACTGATGG<br>CGCGAGGGAGGC | SEQ ID NO:<br>5721 |
| hsIGH_2144_D009_J006_IGHD2-<br>21_IGHJ6 | GCCTTGCCAGCCCGCTCAGGTGTCTACTAGACGGAAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT | SEQ ID NO:<br>5722 |

| | INFORMAL SEQUENCE LISTING | |
|---|---|---|
| | CTACTAGACGGAGTCGACAGTTGGACTTCCCAGGCCGACAGTGGTCTG<br>GCTTCTGAGGGGTCAGGCCAGAATGTGGGGTACGTGGGAGGCCAGCAG<br>AGGGTTCCATGAGAAGGGCAGGGTGTCTACTAGACGGACTGATGGCGC<br>GAGGGAGGC | |
| hsIGH_2145_D010_J006_IGHD3-<br>03_IGHJ6 | GCCTTGCCAGCCCGCTCAGTGCTACACTAGACGGAGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACTAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGTGCTACACTAGACGGACTGATGG<br>CGCGAGGGAGGC | SEQ ID NO:<br>5723 |
| hsIGH_2146_D011_J006_IGHD3-<br>09_IGHJ6 | GCCTTGCCAGCCCGCTCAGAACTGCCATAGACGGATGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCAGGTTTCCCCAGGCCTGCCGGTAGGTTTAG<br>AATGAGGTCTGTGTCACTGTGGTATTACGATATTTTGACTGGTTATTA<br>ACTGCCATAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGAACTGCCATAGACGGACTGATGG<br>CGCGAGGGAGGC | SEQ ID NO:<br>5724 |
| hsIGH_2147_D012_J006_IGHD3-<br>10_IGHJ6 | GCCTTGCCAGCCCGCTCAGTTGGACTGTAGACGGACGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGTAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGTTGGACTGTAGACGGACTGATGG<br>CGCGAGGGAGGC | SEQ ID NO:<br>5725 |
| hsIGH_2148_D013_J006_IGHD3-<br>16_IGHJ6 | GCCTTGCCAGCCCGCTCAGGTAGACACTAGACGGATGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACTAGACGGAGTCGACAGTTGGACTTCCCAGGCCGAC<br>AGTGGTCTGGCTTCTGAGGGGTCAGGCCAGAATGTGGGGTACGTGGGA<br>GGCCAGCAGAGGGTTCCATGAGAAGGGCAGGGTAGACACTAGACGGAC<br>TGATGGCGCGAGGGAGGC | SEQ ID NO:<br>5726 |
| hsIGH_2149_D014_J006_IGHD3-<br>22_IGHJ6 | GCCTTGCCAGCCCGCTCAGCACTGTACTAGACGGATGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA<br>AGTGAGGTCTGTGTCACTGTGGTATTACTATGATAGTAGTGGTTATTC<br>ACTGTACTAGACGGAGTCGACAGTTGGACTTCCCAGGCCGACAGTGGT<br>CTGGCTTCTGAGGGGTCAGGCCAGAATGTGGGGTACGTGGGAGGCCAG<br>CAGAGGGTTCCATGAGAAGGGCAGGCACTGTACTAGACGGACTGATGG<br>CGCGAGGGAGGC | SEQ ID NO:<br>5727 |
| hsIGH_2150_D015_J006_IGHD4-<br>04_IGHJ6 | GCCTTGCCAGCCCGCTCAGGATGATCCTAGACGGACAAGGGTGAGTCA<br>GACCCTCCTGCCCTCGATGGCAGGCGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCTAGACGGA<br>GTCGACAGTTGGACTTCCCAGGCCGACAGTGGTCTGGCTTCTGAGGGG<br>TCAGGCCAGAATGTGGGGTACGTGGGAGGCCAGCAGAGGGTTCCATGA<br>GAAGGGCAGGGATGATCCTAGACGGACTGATGGCGCGAGGGAGGC | SEQ ID NO:<br>5728 |
| hsIGH_2151_D016_J006_IGHD4-<br>11_IGHJ6 | GCCTTGCCAGCCCGCTCAGCGCCAATATAGACGGATGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACAGTACGCCAATATAGACGGA<br>GTCGACAGTTGGACTTCCCAGGCCGACAGTGGTCTGGCTTCTGAGGGG<br>TCAGGCCAGAATGTGGGGTACGTGGGAGGCCAGCAGAGGGTTCCATGA<br>GAAGGGCAGGCGCCAATATAGACGGACTGATGGCGCGAGGGAGGC | SEQ ID NO:<br>5729 |
| hsIGH_2152_D017_J006_IGHD4-<br>17_IGHJ6 | GCCTTGCCAGCCCGCTCAGTCAAGCTTAGACGGAGGAGGGTGAGTCA<br>GACCCACCTGCCCTCGATGGCAGGCGGGGAAGATTCAGAAAGGCCTGA<br>GATCCCCAGGACGCAGCACCACTGTCAATGGGGCCCCAGACGCCTGG<br>ACCAGGGCCTGCGTGGGAAAGGCCGCTGGGCACACTCAGGGGCTTTTT | SEQ ID NO:<br>5730 |

| INFORMAL SEQUENCE LISTING | | |
|---|---|---|
| | GTGAAGGCCCCTCCTACTGTGTGACTACGGTGTCAAGCCTTAGACGGA<br>GTCGACAGTTGGACTTCCCAGGCCGACAGTGGTCTGGCTTCTGAGGGG<br>TCAGGCCAGAATGTGGGGTACGTGGGAGGCCAGCAGAGGGTTCCATGA<br>GAAGGGCAGGTCAAGCCTTAGACGGACTGATGGCGCGAGGGAGGC | |
| hsIGH_2153_D018_J006_IGHD4-<br>23_IGHJ6 | GCCTTGCCAGCCCGCTCAGACGTGTGTTAGACGGAGGAGGGTGAGTCA<br>GACCCACCTGCCCTCAATGGCAGGCGGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTGTTAGAC<br>GGAGTCGACAGTTGGACTTCCCAGGCCGACAGTGGTCTGGCTTCTGAG<br>GGGTCAGGCCAGAATGTGGGGTACGTGGGAGGCCAGCAGAGGGTTCCA<br>TGAGAAGGGCAGGACGTGTGTTAGACGGACTGATGGCGCGAGGGAGGC | SEQ ID NO:<br>5731 |
| hsIGH_2154_D019_J006_IGHD5-<br>05_IGHJ6 | GCCTTGCCAGCCCGCTCAGTCCGTCTATAGACGGAAGAGGCCTCTCCA<br>GGGGGACACTGTGCATGTCTGGTCCCTGAGCAGCCCCCATGTCCCCA<br>GTCCTGGGGGCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTCCGTCTATAGA<br>CGGAGTCGACAGTTGGACTTCCCAGGCCGACAGTGGTCTGGCTTCTGA<br>GGGGTCAGGCCAGAATGTGGGGTACGTGGGAGGCCAGCAGAGGGTTCC<br>ATGAGAAGGGCAGGTCCGTCTATAGACGGACTGATGGCGCGAGGGAGG<br>C | SEQ ID NO:<br>5732 |
| hsIGH_2155_D020_J006_IGHD5-<br>12_IGHJ6 | GCCTTGCCAGCCCGCTCAGAAGAGCTGTAGACGGAGCAGAGGCCTCTC<br>CAGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATATAGTGGCTACGAAGAGCTGT<br>AGACGGAGTCGACAGTTGGACTTCCCAGGCCGACAGTGGTCTGGCTTC<br>TGAGGGGTCAGGCCAGAATGTGGGGTACGTGGGAGGCCAGCAGAGGGT<br>TCCATGAGAAGGGCAGGAAGAGCTGTAGACGGACTGATGGCGCGAGGG<br>AGGC | SEQ ID NO:<br>5733 |
| hsIGH_2156_D021_J006_IGHD5-<br>18_IGHJ6 | GCCTTGCCAGCCCGCTCAGTATCGCTCTAGACGGAGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCTAGA<br>CGGAGTCGACAGTTGGACTTCCCAGGCCGACAGTGGTCTGGCTTCTGA<br>GGGGTCAGGCCAGAATGTGGGGTACGTGGGAGGCCAGCAGAGGGTTCC<br>ATGAGAAGGGCAGGTATCGCTCTAGACGGACTGATGGCGCGAGGGAGG<br>C | SEQ ID NO:<br>5734 |
| hsIGH_2157_D022_J006_IGHD5-<br>24_IGHJ6 | GCCTTGCCAGCCCGCTCAGTCAGATGCTAGACGGAGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCTAGA<br>CGGAGTCGACAGTTGGACTTCCCAGGCCGACAGTGGTCTGGCTTCTGA<br>GGGGTCAGGCCAGAATGTGGGGTACGTGGGAGGCCAGCAGAGGGTTCC<br>ATGAGAAGGGCAGGTCAGATGCTAGACGGACTGATGGCGCGAGGGAGG<br>C | SEQ ID NO:<br>5735 |
| hsIGH_2158_D023_J006_IGHD6-<br>06_IGHJ6 | GCCTTGCCAGCCCGCTCAGGTGTAGCATAGACGGAAGGCAGCTGACTC<br>CTGACTTGGACGCCTATTCCAGACACCAGACAGAGGGGCAGGCCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCATAGACG<br>GAGTCGACAGTTGGACTTCCCAGGCCGACAGTGGTCTGGCTTCTGAGG<br>GGTCAGGCCAGAATGTGGGGTACGTGGGAGGCCAGCAGAGGGTTCCAT<br>GAGAAGGGCAGGGTGTAGCATAGACGGACTGATGGCGCGAGGGAGGC | SEQ ID NO:<br>5736 |
| hsIGH_2159_D024_J006_IGHD6-<br>13_IGHJ6 | GCCTTGCCAGCCCGCTCAGTGGCAGTTTAGACGGAAGGCAGCTGACCC<br>CTGACTTGGACCCCTATTCCAGACACCAGACAGAGGCGCAGGCCCCCC<br>AGAACCAGGGTTGAGGGACGCCCCGTCAAAGCCAGACAAAACCAAGGG<br>GTGTTGAGCCCAGCAAGGGAAGGCCCCAAACAGACCAGGAGGTTTCT<br>GAAGGTGTCTGTGTCACAGTGGGGTATAGCAGCAGCTTGGCAGTTTAG<br>ACGGAGTCGACAGTTGGACTTCCCAGGCCGACAGTGGTCTGGCTTCTG<br>AGGGGTCAGGCCAGAATGTGGGGTACGTGGGAGGCCAGCAGAGGGTTC<br>CATGAGAAGGGCAGGTGGCAGTTTAGACGGACTGATGGCGCGAGGGAG<br>GC | SEQ ID NO:<br>5737 |
| hsIGH_2160_D025_J006_IGHD6-<br>19_IGHJ6 | GCCTTGCCAGCCCGCTCAGCAGTCCAATAGACGGATGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT | SEQ ID NO:<br>5738 |

| | INFORMAL SEQUENCE LISTING | |
|---|---|---|
| | GAAGCTGTCTGTATCACAGTGGGGTATAGCAGTGGCTCAGTCCAATAG<br>ACGGAGTCGACAGTTGGACTTCCCAGGCCGACAGTGGTCTGGCTTCTG<br>AGGGGTCAGGCCAGAATGTGGGGTACGTGGGAGGCCAGCAGAGGGTTC<br>CATGAGAAGGGCAGGCAGTCCAATAGACGGACTGATGGCGCGAGGGAG<br>GC | |
| hsIGH_2161_D026_J006_IGHD6-25_IGHJ6 | GCCTTGCCAGCCCGCTCAGTACGTACGTAGACGGACAGCTGGCCTCTG<br>TCTCGGACCCCCATTCCAGACACCAGACAGAGGGACAGGCCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGTAGACG<br>GAGTCGACAGTTGGACTTCCCAGGCCGACAGTGGTCTGGCTTCTGAGG<br>GGTCAGGCCAGAATGTGGGGTACGTGGGAGGCCAGCAGAGGGTTCCAT<br>GAGAAGGGCAGGTACGTACGTAGACGGACTGATGGCGCGAGGGAGGC | SEQ ID NO:<br>5739 |
| hsIGH_2162_D027_J006_IGHD7-27_IGHJ6 | GCCTTGCCAGCCCGCTCAGAGTACCGATAGACGGAAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT<br>GGCTGAGCTGAGAACCACTGTGCTAACTAGTACCGATAGACGGAGTCG<br>ACAGTTGGACTTCCCAGGCCGACAGTGGTCTGGCTTCTGAGGGGTCAG<br>GCCAGAATGTGGGGTACGTGGGAGGCCAGCAGAGGGTTCCATGAGAAG<br>GGCAGGAGTACCGATAGACGGACTGATGGCGCGAGGGAGGC | SEQ ID NO:<br>5740 |
| hsIGH_2163_D001_J007_IGHD1-01_IGHJp1 | GCCTTGCCAGCCCGCTCAGGACACTCTCAGCTCTTGCCCCGGTCTCTG<br>TGGGTGTTCCGCTAACTGGGGCTCCCAGTGCTCACCCCACAACTAAAG<br>CGAGCCCCAGCCTCCAGAGCCCCGAAGGAGATGCCGCCCACAAGCCC<br>AGCCCCCATCCAGGAGGCCCCAGAGCTCAGGGCGCCGGGGCAGATTCT<br>GAACAGCCCCGAGTCACGGTGGGTACAACTGGAGACACTCTCAGCTCT<br>TGTCGACTTTGACTACTGGGGCCAGGGAACCCTGGTCACCGTCTCCTC<br>AGGTGAGTCCTCACAACCTCTCTCCTGCTTTAACTCTGAAGGGTTTTG<br>CTGCATTTCTGGACACTCTCAGCTCTTCTGATGGCGCGAGGGAGGC | SEQ ID NO:<br>5741 |
| hsIGH_2164_D002_J007_IGHD1-07_IGHJp1 | GCCTTGCCAGCCCGCTCAGTTCGGAACCAGCTCTTGGCCTCGGTCTCT<br>GTGGGTGTTCCGCTAGCTGGGGCTCACAGTGCTCACCCCACACCTAAA<br>ACGAGCCACAGCCTCAGAGCCCCTGAAGGAGACCCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACCAGCTCT<br>TGTCGACTTTGACTACTGGGGCCAGGGAACCCTGGTCACCGTCTCCTC<br>AGGTGAGTCCTCACAACCTCTCTCCTGCTTTAACTCTGAAGGGTTTTG<br>CTGCATTTCTGTTCGGAACCAGCTCTTCTGATGGCGCGAGGGAGGC | SEQ ID NO:<br>5742 |
| hsIGH_2165_D003_J007_IGHD1-14_IGHJp1 | GCCTTGCCAGCCCGCTCAGAAGTAACGCAGCTCTTGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGCAGCTCT<br>TGTCGACTTTGACTACTGGGGCCAGGGAACCCTGGTCACCGTCTCCTC<br>AGGTGAGTCCTCACAACCTCTCTCCTGCTTTAACTCTGAAGGGTTTTG<br>CTGCATTTCTGAAGTAACGCAGCTCTTCTGATGGCGCGAGGGAGGC | SEQ ID NO:<br>5743 |
| hsIGH_2166_D004_J007_IGHD1-20_IGHJp1 | GCCTTGCCAGCCCGCTCAGGTCTCCTACAGCTCTTGTCTCTGTGGGTG<br>TTCCGCTAGCTGGGGCCCCAGTGCTCACCCCACACCTAAAGCCAGC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAA CAGCCCCGAGTCACAGTGGGTATAACTGGAGTCTCCTACAGCTCT<br>TGTCGACTTTGACTACTGGGGCCAGGGAACCCTGGTCACCGTCTCCTC<br>AGGTGAGTCCTCACAACCTCTCTCCTGCTTTAACTCTGAAGGGTTTTG<br>CTGCATTTCTGGTCTCCTACAGCTCTTCTGATGGCGCGAGGGAGGC | SEQ ID NO:<br>5744 |
| hsIGH_2167_D005_J007_IGHD1-26_IGHJp1 | GCCTTGCCAGCCCGCTCAGAGAGTGTCCAGCTCTTAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCCAGC<br>TCTTGTCGACTTTGACTACTGGGGCCAGGGAACCCTGGTCACCGTCTC<br>CTCAGGTGAGTCCTCACAACCTCTCTCCTGCTTTAACTCTGAAGGGTT<br>TTGCTGCATTTCTGAGAGTGTCCAGCTCTTCTGATGGCGCGAGGGAGG<br>C | SEQ ID NO:<br>5745 |
| hsIGH_2168_D006_J007_IGHD2-02_IGHJp1 | GCCTTGCCAGCCCGCTCAGGTTCCGAACAGCTCTTAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAACAGCTCTTGTCGACTTTGACTACTGGGGCCAGGGAACCCTG<br>GTCACCGTCTCCTCAGGTGAGTCCTCACAACCTCTCTCCTGCTTTAAC | SEQ ID NO:<br>5746 |

| INFORMAL SEQUENCE LISTING | | |
|---|---|---|
| | TCTGAAGGGTTTTGCTGCATTTCTGGTTCCGAACAGCTCTTCTGATGG<br>CGCGAGGGAGGC | |
| hsIGH_2169_D007_J007_IGHD2-<br>08_IGHJp1 | GCCTTGCCAGCCCGCTCAGCGTTACTTCAGCTCTTAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTCAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGCGTTACTTCAGCTCTTCTGATGG<br>CGCGAGGGAGGC | SEQ ID NO:<br>5747 |
| hsIGH_2170_D008_J007_IGHD2-<br>15_IGHJp1 | GCCTTGCCAGCCCGCTCAGTAGGAGACCAGCTCTTAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACCAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGTAGGAGACCAGCTCTTCTGATGG<br>CGCGAGGGAGGC | SEQ ID NO:<br>5748 |
| hsIGH_2171_D009_J007_IGHD2-<br>21_IGHJp1 | GCCTTGCCAGCCCGCTCAGGTGTCTACCAGCTCTTAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT<br>CTACCAGCTCTTGTCGACTTTGACTACTGGGGCCAGGGAACCCTGGTC<br>ACCGTCTCCTCAGGTGAGTCCTCACAACCTCTCTCCTGCTTTAACTCT<br>GAAGGGTTTTGCTGCATTTCTGGTGTCTACCAGCTCTTCTGATGGCGC<br>GAGGGAGGC | SEQ ID NO:<br>5749 |
| hsIGH_2172_D010_J007_IGHD3-<br>03_IGHJp1 | GCCTTGCCAGCCCGCTCAGTGCTACACCAGCTCTTGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACCAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGTGCTACACCAGCTCTTCTGATGG<br>CGCGAGGGAGGC | SEQ ID NO:<br>5750 |
| hsIGH_2173_D011_J007_IGHD3-<br>09_IGHJp1 | GCCTTGCCAGCCCGCTCAGAACTGCCACAGCTCTTTGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCAGGTTTCCCCAGGCCTGCCGGTAGGTTTAG<br>AATGAGGTCTGTGTCACTGTGGTATTACGATATTTTGACTGGTTATTA<br>ACTGCCACAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGAACTGCCACAGCTCTTCTGATGG<br>CGCGAGGGAGGC | SEQ ID NO:<br>5751 |
| hsIGH_2174_D012_J007_IGHD3-<br>10_IGHJp1 | GCCTTGCCAGCCCGCTCAGTGGACTGCAGCTCTTCGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGCAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGTTGGACTGCAGCTCTTCTGATGG<br>CGCGAGGGAGGC | SEQ ID NO:<br>5752 |
| hsIGH_2175_D013_J007_IGHD3-<br>16_IGHJp1 | GCCTTGCCAGCCCGCTCAGGTAGACACCAGCTCTTTGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACCAGCTCTTGTCGACTTTGACTACTGGGGCCAGGGA<br>ACCCTGGTCACCGTCTCCTCAGGTGAGTCCTCACAACCTCTCTCCTGC<br>TTTAACTCTGAAGGGTTTTGCTGCATTTCTGGTAGACACCAGCTCTTC<br>TGATGGCGCGAGGGAGGC | SEQ ID NO:<br>5753 |
| hsIGH_2176_D014_J007_IGHD3-<br>22_IGHJp1 | GCCTTGCCAGCCCGCTCAGCACTGTACCAGCTCTTTGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA | SEQ ID NO:<br>5754 |

| | INFORMAL SEQUENCE LISTING | |
|---|---|---|
| | AGTGAGGTCTGTGTCACTGTGGTATTACTATGATAGTAGTGGTTATTC<br>ACTGTACCAGCTCTTGTCGACTTTGACTACTGGGGCCAGGGAACCCTG<br>GTCACCGTCTCCTCAGGTGAGTCCTCACAACCTCTCTCCTGCTTTAAC<br>TCTGAAGGGTTTTGCTGCATTTCTGCACTGTACCAGCTCTTCTGATGG<br>CGCGAGGGAGGC | |
| hsIGH_2177_D015_J007_IGHD4-<br>04_IGHJp1 | GCCTTGCCAGCCCGCTCAGGATGATCCCAGCTCTTCAAGGGTGAGTCA<br>GACCCTCCTGCCCTCGATGGCAGGCGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCCAGCTCTT<br>GTCGACTTTGACTACTGGGGCCAGGGAACCCTGGTCACCGTCTCCTCA<br>GGTGAGTCCTCACAACCTCTCTCCTGCTTTAACTCTGAAGGGTTTTGC<br>TGCATTTCTGGATGATCCCAGCTCTTCTGATGGCGCGAGGGAGGC | SEQ ID NO:<br>5755 |
| hsIGH_2178_D016_J007_IGHD4-<br>11_IGHJp1 | GCCTTGCCAGCCCGCTCAGCGCCAATACAGCTCTTTGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACGCCAATACAGCTCTT<br>GTCGACTTTGACTACTGGGGCCAGGGAACCCTGGTCACCGTCTCCTCA<br>GGTGAGTCCTCACAACCTCTCTCCTGCTTTAACTCTGAAGGGTTTTGC<br>TGCATTTCTGCGCCAATACAGCTCTTCTGATGGCGCGAGGGAGGC | SEQ ID NO:<br>5756 |
| hsIGH_2179_D017_J007_IGHD4-<br>17_IGHJp1 | GCCTTGCCAGCCCGCTCAGTCAAGCCTCAGCTCTTGGAGGGTGAGTCA<br>GACCCACCTGCCCTCGATGGCAGGCGGGAAGATTCAGAAAGGCCTGA<br>GATCCCCAGGACGCAGCACCACTGTCAATGGGGGCCCCAGACGCCTGG<br>ACCAGGGCCTGCGTGGGAAAGGCCGCTGGGCACACTCAGGGGCTTTTT<br>GTGAAGGCCCCTCCTACTGTGTGACTACGGTGTCAAGCCTCAGCTCTT<br>GTCGACTTTGACTACTGGGGCCAGGGAACCCTGGTCACCGTCTCCTCA<br>GGTGAGTCCTCACAACCTCTCTCCTGCTTTAACTCTGAAGGGTTTTGC<br>TGCATTTCTGTCAAGCCTCAGCTCTTCTGATGGCGCGAGGGAGGC | SEQ ID NO:<br>5757 |
| hsIGH_2180_D018_J007_IGHD4-<br>23_IGHJp1 | GCCTTGCCAGCCCGCTCAGACGTGTGTCAGCTCTTGGAGGGTGAGTCA<br>GACCCACCTGCCCTCAATGGCAGGCGGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTGTCAGCT<br>CTTGTCGACTTTGACTACTGGGGCCAGGGAACCCTGGTCACCGTCTCC<br>TCAGGTGAGTCCTCACAACCTCTCTCCTGCTTTAACTCTGAAGGGTTT<br>TGCTGCATTTCTGACGTGTGTCAGCTCTTCTGATGGCGCGAGGGAGGC | SEQ ID NO:<br>5758 |
| hsIGH_2181_D019_J007_IGHD5-<br>05_IGHJp1 | GCCTTGCCAGCCCGCTCAGTCCGTCTACAGCTCTTAGAGGCCTCTCCA<br>GGGGGACACTGTGCATGTCTGGTCCCTGAGCAGCCCCCCATGTCCCCA<br>GTCCTGGGGGCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTCCGTCTACAGC<br>TCTTGTCGACTTTGACTACTGGGGCCAGGGAACCCTGGTCACCGTCTC<br>CTCAGGTGAGTCCTCACAACCTCTCTCCTGCTTTAACTCTGAAGGGTT<br>TTGCTGCATTTCTGTCCGTCTACAGCTCTTCTGATGGCGCGAGGGAGG<br>C | SEQ ID NO:<br>5759 |
| hsIGH_2182_D020_J007_IGHD5-<br>12_IGHJp1 | GCCTTGCCAGCCCGCTCAGAAGAGCTGCAGCTCTTGCAGAGGCCTCTC<br>CAGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATATAGTGGCTACGAAGAGCTGC<br>AGCTCTTGTCGACTTTGACTACTGGGGCCAGGGAACCCTGGTCACCGT<br>CTCCTCAGGTGAGTCCTCACAACCTCTCTCCTGCTTTAACTCTGAAGG<br>GTTTTGCTGCATTTCTGAAGAGCTGCAGCTCTTCTGATGGCGCGAGGG<br>AGGC | SEQ ID NO:<br>5760 |
| hsIGH_2183_D021_J007_IGHD5-<br>18_IGHJp1 | GCCTTGCCAGCCCGCTCAGTATCGCTCCAGCTCTTGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGGATACAGCTATGTATCGCTCCAGC<br>TCTTGTCGACTTTGACTACTGGGGCCAGGGAACCCTGGTCACCGTCTC<br>CTCAGGTGAGTCCTCACAACCTCTCTCCTGCTTTAACTCTGAAGGGTT<br>TTGCTGCATTTCTGTATCGCTCCAGCTCTTCTGATGGCGCGAGGGAGG<br>C | SEQ ID NO:<br>5761 |
| hsIGH_2184_D022_J007_IGHD5-<br>24_IGHJp1 | GCCTTGCCAGCCCGCTCAGTCAGATGCCAGCTCTTGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCCAGC | SEQ ID NO:<br>5762 |

| | INFORMAL SEQUENCE LISTING | |
|---|---|---|
| | TCTTGTCGACTTTGACTACTGGGGCCAGGGAACCCTGGTCACCGTCTC<br>CTCAGGTGAGTCCTCACAACCTCTCTCCTGCTTTAACTCTGAAGGGTT<br>TTGCTGCATTTCTGTCAGATGCCAGCTCTTCTGATGGCGCGAGGGAGG<br>C | |
| hsIGH_2185_D023_J007_IGHD6-<br>06_IGHJp1 | GCCTTGCCAGCCCGCTCAGGTGTAGCACAGCTCTTAGGCAGCTGACTC<br>CTGACTTGGACGCCTATTCCAGACACCAGACAGAGGGGCAGGCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCACAGCTC<br>TTGTCGACTTTGACTACTGGGGCCAGGGAACCTGGTCACCGTCTCCT<br>CAGGTGAGTCCTCACAACCTCTCTCCTGCTTTAACTCTGAAGGGTTTT<br>GCTGCATTTCTGGTGTAGCACAGCTCTTCTGATGGCGCGAGGGAGGC | SEQ ID NO:<br>5763 |
| hsIGH_2186_D024_J007_IGHD6-<br>13_IGHJp1 | GCCTTGCCAGCCCGCTCAGTGGCAGTTCAGCTCTTAGGCAGCTGACCC<br>CTGACTTGGACCCCTATTCCAGACACCAGACAGAGGCGCAGGCCCCCC<br>AGAACCAGGGTTGAGGGACGCCCCGTCAAAGCCAGACAAAACCAAGGG<br>GTGTTGAGCCCAGCAAGGGAAGGCCCCCAAACAGACCAGGAGGTTTCT<br>GAAGGTGTCTGTGTCACAGTGGGGTATAGCAGCAGCTTGGCAGTTCAG<br>CTCTTGTCGACTTTGACTACTGGGGCCAGGGAACCCTGGTCACCGTCT<br>CCTCAGGTGAGTCCTCACAACCTCTCTCCTGCTTTAACTCTGAAGGGT<br>TTTGCTGCATTTCTGTGGCAGTTCAGCTCTTCTGATGGCGCGAGGGAG<br>GC | SEQ ID NO:<br>5764 |
| hsIGH_2187_D025_J007_IGHD6-<br>19_IGHJp1 | GCCTTGCCAGCCCGCTCAGCAGTCCAACAGCTCTTTGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAACAG<br>CTCTTGTCGACTTTGACTACTGGGGCCAGGGAACCCTGGTCACCGTCT<br>CCTCAGGTGAGTCCTCACAACCTCTCTCCTGCTTTAACTCTGAAGGGT<br>TTTGCTGCATTTCTGCAGTCCAACAGCTCTTCTGATGGCGCGAGGGAG<br>GC | SEQ ID NO:<br>5765 |
| hsIGH_2188_D026_J007_IGHD6-<br>25_IGHJp1 | GCCTTGCCAGCCCGCTCAGTACGTACGCAGCTCTTCAGCTGGCCTCTG<br>TCTCGGACCCCCATTCCAGACACCAGACAGAGGGACAGGCCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGCAGCTC<br>TTGTCGACTTTGACTACTGGGGCCAGGGAACCCTGGTCACCGTCTCCT<br>CAGGTGAGTCCTCACAACCTCTCTCCTGCTTTAACTCTGAAGGGTTTT<br>GCTGCATTTCTGTACGTACGCAGCTCTTCTGATGGCGCGAGGGAGGC | SEQ ID NO:<br>5766 |
| hsIGH_2189_D027_J007_IGHD7-<br>27_IGHJp1 | GCCTTGCCAGCCCGCTCAGAGTACCGACAGCTCTTAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT<br>GGCTGAGCTGAGAACCACTGTGCTAACTAGTACCGACAGCTCTTGTCG<br>ACTTTGACTACTGGGGCCAGGGAACCCTGGTCACCGTCTCCTCAGGTG<br>AGTCCTCACAACCTCTCTCCTGCTTTAACTCTGAAGGGTTTTGCTGCA<br>TTTCTGAGTACCGACAGCTCTTCTGATGGCGCGAGGGAGGC | SEQ ID NO:<br>5767 |
| hsIGH_2190_D001_J008_IGHD1-<br>01_IGHJp2 | GCCTTGCCAGCCCGCTCAGGACACTCTGAGCGATAGCCCCGGTCTCTG<br>TGGGTGTTCCGCTAACTGGGGCTCCCAGTGCTCACCCCACAACTAAAG<br>CGAGCCCCAGCCTCCAGAGCCCCCGAAGGAGATGCCGCCCACAAGCCC<br>AGCCCCCATCCAGGAGGCCCCAGAGCTCAGGGCGCCGGGGCAGATTCT<br>GAACAGCCCCGAGTCACGGTGGGTACAACTGGAGACACTCTGAGCGAT<br>AGTCGACTGGTTCGACCCCTGGGGCCAGGGAACCCTGGTCACCGTCTC<br>CTCAGGTGAGTCCTCACCACCCCCTCTCTGAGTCCACTTAGGGAGACT<br>CAGCTTGCCAGGACACTCTGAGCGATACTGATGGCGCGAGGGAGGC | SEQ ID NO:<br>5768 |
| hsIGH_2191_D002_J008_IGHD1-<br>07_IGHJp2 | GCCTTGCCAGCCCGCTCAGTTCGGAACGAGCGATAGGCCTCGGTCTCT<br>GTGGGTGTTCCGCTAGCTGGGGCTCACAGTGCTCACCCCACACCTAAA<br>ACGAGCCACAGCCTCCAGAGCCCCTGAAGGAGACCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACGAGCGAT<br>AGTCGACTGGTTCGACCCCTGGGGCCAGGGAACCCTGGTCACCGTCTC<br>CTCAGGTGAGTCCTCACCACCCCCTCTCTGAGTCCACTTAGGGAGACT<br>CAGCTTGCCAGTTCGGAACGAGCGATACTGATGGCGCGAGGGAGGC | SEQ ID NO:<br>5769 |
| hsIGH_2192_D003_J008_IGHD1-<br>14_IGHJp2 | GCCTTGCCAGCCCGCTCAGAAGTAACGGAGCGATAGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGGAGCGAT | SEQ ID NO:<br>5770 |

-continued

| INFORMAL SEQUENCE LISTING | | |
|---|---|---|
| | AGTCGACTGGTTCGACCCCTGGGGCCAGGGAACCCTGGTCACCGTCTC CTCAGGTGAGTCCTCACCACCCCTCTCTGAGTCCACTTAGGGAGACT CAGCTTGCCAGAAGTAACGGAGCGATACTGATGGCGCGAGGGAGGC | |
| hsIGH_2193_D004_J008_IGHD1-20_IGHJp2 | GCCTTGCCAGCCCGCTCAGGTCTCCTAGAGCGATAGTCTCTGTGGGTG TTCCGCTAGCTGGGGCCCCCAGTGCTCACCCCACACCTAAAGCGAGCC CCAGCCTCCAGAGCCCCCTAAGCATTCCCCGCCCAGCAGCCCAGCCCC TGCCCCCACCCAGGAGGCCCCAGAGCTCAGGGCGCCTGGTCGGATTCT GAACAGCCCCGAGTCACAGTGGGTATAACTGGAGTCTCCTAGAGCGAT AGTCGACTGGTTCGACCCCTGGGGCAGGGAACCCTGGTCACCGTCTC CTCAGGTGAGTCCTCACCACCCCTCTCTGAGTCCACTTAGGGAGACT CAGCTTGCCAGGTCTCCTAGAGCGATACTGATGGCGCGAGGGAGGC | SEQ ID NO: 5771 |
| hsIGH_2194_D005_J008_IGHD1-26_IGHJp2 | GCCTTGCCAGCCCGCTCAGAGAGTGTCGAGCGATAAGGCCTCAGGCTC TGTGGGTGCCGCTAGCTGGGGCTGCCAGTCCTCACCCCACACCTAAGG TGAGCCACAGCCGCCAGAGCCTCCACAGGAGACCCCACCCAGCAGCCC AGCCCCTACCCAGGAGGCCCCAGAGCTCAGGGCGCCTGGGTGGATTCT GAACAGCCCCGAGTCACGGTGGGTATAGTGGGAGCTAGAGTGTCGAGC GATAGTCGACTGGTTCGACCCCTGGGGCCAGGGAACCCTGGTCACCGT CTCCTCAGGTGAGTCCTCACCACCCCTCTCTGAGTCCACTTAGGGAG ACTCAGCTTGCCAGAGAGTGTCGAGCGATACTGATGGCGCGAGGGAGG C | SEQ ID NO: 5772 |
| hsIGH_2195_D006_J008_IGHD2-02_IGHJp2 | GCCTTGCCAGCCCGCTCAGGTTCCGAAGAGCGATAAAAGGAGGAGCCC CCTGTACAGCACTGGGCTCAGAGTCCTCTCCCACACACCCTGAGTTTC AGACAAAAACCCCCTGGAAATCATAGTATCAGCAGGAGAACTAGCCAG AGACAGCAAGAGGGGACTCAGTGACTCCCGCGGGGACAGGAGGATTTT GTGGGGGCTCGTGTCACTGTGAGGATATTGTAGTAGTACCAGCTGCTG TTCCGAAGAGCGATAGTCGACTGGTTCGACCCCTGGGGCCAGGGAACC CTGGTCACCGTCTCCTCAGGTGAGTCCTCACCACCCCTCTCTGAGTC CACTTAGGGAGACTCAGCTTGCCAGGTTCCGAAGAGCGATACTGATGG CGCGAGGGAGGC | SEQ ID NO: 5773 |
| hsIGH_2196_D007_J008_IGHD2-08_IGHJp2 | GCCTTGCCAGCCCGCTCAGCGTTACTTGAGCGATAAAAGGAGGAGCCC CTTGTTCAGCACTGGGCTCAGAGTCCTCTCCAAGACACCCAGAGTTTC AGACAAAAACCCCCTGGAATGCACAGTCTCAGCAGGAGAGCCAGCCAG AGCCAGCAAGATGGGGCTCAGTGACACCCGCAGGGACAGGAGGATTTT GTGGGGGCTCGTGTCACTGTGAGGATATTGTACTAATGGTGTATGCTC GTTACTTGAGCGATAGTCGACTGGTTCGACCCCTGGGGCCAGGGAACC CTGGTCACCGTCTCCTCAGGTGAGTCCTCACCACCCCTCTCTGAGTC CACTTAGGGAGACTCAGCTTGCCAGCGTTACTTGAGCGATACTGATGG CGCGAGGGAGGC | SEQ ID NO: 5774 |
| hsIGH_2197_D008_J008_IGHD2-15_IGHJp2 | GCCTTGCCAGCCCGCTCAGTAGGAGACGAGCGATAAAAGGAGGAGCCC CCTATACAGCACTGGGCTCAGAGTCCTCTCTGAGACACCCTGAGTTTC AGACAACAACCCGCTGGAATGCACAGTCTCAGCAGGAGAACAGACCAA AGCCAGCAAAAGGGACCTCGGTGACACCAGTAGGGACAGGAGGATTTT GTGGGGGCTCGTGTCACTGTGAGGATATTGTAGTGGTGGTAGCTGCTT AGGAGACGAGCGATAGTCGACTGGTTCGACCCCTGGGGCCAGGGAACC CTGGTCACCGTCTCCTCAGGTGAGTCCTCACCACCCCTCTCTGAGTC CACTTAGGGAGACTCAGCTTGCCAGTAGGAGACGAGCGATACTGATGG CGCGAGGGAGGC | SEQ ID NO: 5775 |
| hsIGH_2198_D009_J008_IGHD2-21_IGHJp2 | GCCTTGCCAGCCCGCTCAGGTGTCTACGAGCGATAAGCCCCCTGTACA GCACTGGGCTCAGAGTCCTCTCTGAGACAGGCTCAGTTTCAGACAACA ACCCGCTGGAATGCACAGTCTCAGCAGGAGAGCCAGGCCAGAGCCAGC AAGAGGAGACTCGGTGACACCAGTCTCCTGTAGGGACAGGAGGATTTT GTGGGGGTTCGTGTCACTGTGAGCATATTGTGGTGGTGACTGCTGTGT CTACGAGCGATAGTCGACTGGTTCGACCCCTGGGGCCAGGGAACCCTG GTCACCGTCTCCTCAGGTGAGTCCTCACCACCCCTCTCTGAGTCCAC TTAGGGAGACTCAGCTTGCCAGGTGTCTACGAGCGATACTGATGGCGC GAGGGAGGC | SEQ ID NO: 5776 |
| hsIGH_2199_D010_J008_IGHD3-03_IGHJp2 | GCCTTGCCAGCCCGCTCAGTGCTACACGAGCGATAGTGGGCACGGACA CTGTCCACCTAAGCCAGGGGCAGACCCGAGTGTCCCCGCAGTAGACCT GAGAGCGCTGGGCCCACAGCCTCCCCTCGGTGCCCTGCTACCTCCTCA GGTCAGCCCTGGACATCCCGGGTTTCCCCAGGCTGGCGGTAGGTTTGG GGTGAGGTCTGTGTCACTGTGGTATTACGATTTTTGGAGTGGTTATTT GCTACACGAGCGATAGTCGACTGGTTCGACCCCTGGGGCAGGGAACC CTGGTCACCGTCTCCTCAGGTGAGTCCTCACCACCCCTCTCTGAGTC CACTTAGGGAGACTCAGCTTGCCAGTGCTACACGAGCGATACTGATGG CGCGAGGGAGGC | SEQ ID NO: 5777 |
| hsIGH_2200_D011_J008_IGHD3-09_IGHJp2 | GCCTTGCCAGCCCGCTCAGAACTGCCAGAGCGATATGGGCACGGACAC TATCCACATAAGCGAGGGATAGACCCGAGTGTCCCCACAGCAGACCTG AGAGCGCTGGGCCCACAGCCTCCCCTCAGAGCCCTGCTGCCTCCTCCG GTCAGCCCTGGACATCCCAGGTTTCCCCAGGCCTGCCGGTAGGTTTAG | SEQ ID NO: 5778 |

-continued

| INFORMAL SEQUENCE LISTING | | |
|---|---|---|
| | AATGAGGTCTGTGTCACTGTGGTATTACGATATTTTGACTGGTTATTA<br>ACTGCCAGAGCGATAGTCGACTGGTTCGACCCCTGGGGCCAGGGAACC<br>CTGGTCACCGTCTCCTCAGGTGAGTCCTCACCACCCCCTCTCTGAGTC<br>CACTTAGGGAGACTCAGCTTGCCAGAACTGCCAGAGCGATACTGATGG<br>CGCGAGGGAGGC | |
| hsIGH_2201_D012_J008_IGHD3-<br>10_IGHJp2 | GCCTTGCCAGCCCGCTCAGTTGGACTGGAGCGATACGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGGAGCGATAGTCGACTGGTTCGACCCCTGGGGCCAGGGAACC<br>CTGGTCACCGTCTCCTCAGGTGAGTCCTCACCACCCCCTCTCTGAGTC<br>CACTTAGGGAGACTCAGCTTGCCAGTTGGACTGGAGCGATACTGATGG<br>CGCGAGGGAGGC | SEQ ID NO:<br>5779 |
| hsIGH_2202_D013_J008_IGHD3-<br>16_IGHJp2 | GCCTTGCCAGCCCGCTCAGGTAGACACGAGCGATATGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGGAGTTA<br>TCGTTGTAGACACGAGCGATAGTCGACTGGTTCGACCCCTGGGGCCAG<br>GGAACCCTGGTCACCGTCTCCTCAGGTGAGTCCTCACCACCCCCTCTC<br>TGAGTCCACTTAGGGAGACTCAGCTTGCCAGGTAGACACGAGCGATAC<br>TGATGGCGCGAGGGAGGC | SEQ ID NO:<br>5780 |
| hsIGH_2203_D014_J008_IGHD3-<br>22_IGHJp2 | GCCTTGCCAGCCCGCTCAGCACTGTACGAGCGATATGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA<br>AGTGAGGTCTGTGTCACTGTGGTATTACTATGATAGTAGTGGTTATTC<br>ACTGTACGAGCGATAGTCGACTGGTTCGACCCCTGGGGCCAGGGAACC<br>CTGGTCACCGTCTCCTCAGGTGAGTCCTCACCACCCCCTCTCTGAGTC<br>CACTTAGGGAGACTCAGCTTGCCAGCACTGTACGAGCGATACTGATGG<br>CGCGAGGGAGGC | SEQ ID NO:<br>5781 |
| hsIGH_2204_D015_J008_IGHD4-<br>04_IGHJp2 | GCCTTGCCAGCCCGCTCAGGATGATCCGAGCGATACAAGGGTGAGTCA<br>GACCCTCCTGCCCTCGATGGCAGGCGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCGAGCGATA<br>GTCGACTGGTTCGACCCCTGGGGCCAGGGAACCCTGGTCACCGTCTCC<br>TCAGGTGAGTCCTCACCACCCCCTCTCTGAGTCCACTTAGGGAGACTC<br>AGCTTGCCAGGATGATCCGAGCGATACTGATGGCGCGAGGGAGGC | SEQ ID NO:<br>5782 |
| hsIGH_2205_D016_J008_IGHD4-<br>11_IGHJp2 | GCCTTGCCAGCCCGCTCAGCGCCAATAGAGCGATATGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT<br>GTGAAGGGCCCTCCTGCTGTGTGACTACAGTACGCCAATAGAGCGATA<br>GTCGACTGGTTCGACCCCTGGGGCCAGGGAACCCTGGTCACCGTCTCC<br>TCAGGTGAGTCCTCACCACCCCCTCTCTGAGTCCACTTAGGGAGACTC<br>AGCTTGCCAGCGCCAATAGAGCGATACTGATGGCGCGAGGGAGGC | SEQ ID NO:<br>5783 |
| hsIGH_2206_D017_J008_IGHD4-<br>17_IGHJp2 | GCCTTGCCAGCCCGCTCAGTCAAGCCTGAGCGATAGGAGGGTGAGTCA<br>GACCCACCTGCCCTCGATGGCAGGCGGGAAGATTCAGAAAGGCCTGA<br>GATCCCCAGGACGCAGCACCACTGTCAATGGGGGCCCCAGACGCCTGG<br>ACCAGGGCCTGCGTGGGAAAGGCCGCTGGGCACACTCAGGGGCTTTTT<br>GTGAAGGCCCCTCCTACTGTGTGACTACGGTGTCAAGCCTGAGCGATA<br>GTCGACTGGTTCGACCCCTGGGGCCAGGGAACCCTGGTCACCGTCTCC<br>TCAGGTGAGTCCTCACCACCCCCTCTCTGAGTCCACTTAGGGAGACTC<br>AGCTTGCCAGTCAAGCCTGAGCGATACTGATGGCGCGAGGGAGGC | SEQ ID NO:<br>5784 |
| hsIGH_2207_D018_J008_IGHD4-<br>23_IGHJp2 | GCCTTGCCAGCCCGCTCAGACGTGTGTGAGCGATAGGAGGGTGAGTCA<br>GACCCACCTGCCCTCAATGGCAGGCGGGAAGATTCAGAAAGGCCTGA<br>GATCCCCAGGACGCAGCACCACTGTCAATGGGGGCCCCAGACGCCTGG<br>ACCAGGGCCTGTGTGGGAAAGGCCTCTGGCCACACTCAGGGGCTTTTT<br>GTGAAGGGCCCTCCTGCTGTGTGACTACGGTGGTAACGTGTGTGAGCG<br>ATAGTCGACTGGTTCGACCCCTGGGGCCAGGGAACCCTGGTCACCGTC<br>TCCTCAGGTGAGTCCTCACCACCCCCTCTCTGAGTCCACTTAGGGAGA<br>CTCAGCTTGCCAGACGTGTGTGAGCGATACTGATGGCGCGAGGGAGGC | SEQ ID NO:<br>5785 |
| hsIGH_2208_D019_J008_IGHD5-<br>05_IGHJp2 | GCCTTGCCAGCCCGCTCAGTCCGTCTAGAGCGATAAGAGGCCTCTCCA<br>GGGGGACACTGTGCATGTCTGGTCCCTGAGCAGCCCCCATGTCCCCA<br>GTCCTGGGGGCCCCCTGGCACAGCTGTCTGGACCCTCTCTATTCCCT<br>GGGAAGCTCCTCCTGACAGCCCCGCCTCCAGTTCCAGGTGTGGTTATT<br>GTCAGGGGTGTCAGACTGTGGTGGATACAGCTATGTCCGTCTAGAGC | SEQ ID NO:<br>5786 |

| | INFORMAL SEQUENCE LISTING | |
|---|---|---|
| | GATAGTCGACTGGTTCGACCCCTGGGGCCAGGGAACCCTGGTCACCGT<br>CTCCTCAGGTGAGTCCTCACCACCCCCTCTCTGAGTCCACTTAGGGAG<br>ACTCAGCTTGCCAGTCCGTCTAGAGCGATACTGATGGCGCGAGGGAGG<br>C | |
| hsIGH_2209_D020_J008_IGHD5-<br>12_IGHJp2 | GCCTTGCCAGCCCGCTCAGAAGAGCTGGAGCGATAGCAGAGGCCTCTC<br>CAGGGGAGACACTGTGCATGTCTGGTACCTAAGCAGCCCCCCACGTCCC<br>CAGTCCTGGGGGCCCCTGGCTCAGCTGTCTGGACCCTCCCTGTTCCCT<br>GGGAAGCTCCTCCTGACAGCCCCGCCTCCAGTTCCAGGTGTGGTTATT<br>GTCAGGCGATGTCAGACTGTGGTGGATATAGTGGCTACGAAGAGCTGG<br>AGCGATAGTCGACTGGTTCGACCCCTGGGGCCAGGGAACCCTGGTCAC<br>CGTCTCCTCAGGTGAGTCCTCACCACCCCCTCTCTGAGTCCACTTAGG<br>GAGACTCAGCTTGCCAGAAGAGCTGGAGCGATACTGATGGCGCGAGGG<br>AGGC | SEQ ID NO:<br>5787 |
| hsIGH_2210_D021_J008_IGHD5-<br>18_IGHJp2 | GCCTTGCCAGCCCGCTCAGTATCGCTCGAGCGATAGCAGAGGCCTCTC<br>CAGGGGGACACTGTGCATGTCTGGTCCCTGAGCAGCCCCCCACGTCCC<br>CAGTCCTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGTCAGACTGTGGTGATACAGCTATGTATCGCTCGAGC<br>GATAGTCGACTGGTTCGACCCCTGGGGCCAGGGAACCCTGGTCACCGT<br>CTCCTCAGGTGAGTCCTCACCACCCCCTCTCTGAGTCCACTTAGGGAG<br>ACTCAGCTTGCCAGTATCGCTCGAGCGATACTGATGGCGCGAGGGAGG<br>C | SEQ ID NO:<br>5788 |
| hsIGH_2211_D022_J008_IGHD5-<br>24_IGHJp2 | GCCTTGCCAGCCCGCTCAGTCAGATGCGAGCGATAGCAGAGGCCTCTC<br>CAGGGGGACACAGTGCATGTCTGGTCCCTGAGCAGCCCCCAGGCTCTC<br>TAGCACTGGGGGCCCCTGGCACAGCTGTCTGGACCCTCCCTGTTCCCT<br>GGGAAGCTCCTCCTGACAGCCCCGCCTCCAGTTCCAGGTGTGGTTATT<br>GTCAGGGGGTGCCAGGCCGTGGTAGAGATGGCTACATCAGATGCGAGC<br>GATAGTCGACTGGTTCGACCCCTGGGGCCAGGGAACCCTGGTCACCGT<br>CTCCTCAGGTGAGTCCTCACCACCCCCTCTCTGAGTCCACTTAGGGAG<br>ACTCAGCTTGCCAGTCAGATGCGAGCGATACTGATGGCGCGAGGGAGG<br>C | SEQ ID NO:<br>5789 |
| hsIGH_2212_D023_J008_IGHD6-<br>06_IGHJp2 | GCCTTGCCAGCCCGCTCAGGTGTAGCAGAGCGATAAGGCAGCTGACTC<br>CTGACTTGGACGCCTATTCCAGACACCAGACAGAGGGGCAGGCCCCCC<br>AGAACCAGGGATGAGGACGCCCCGTCAAGGCCAGAAAAGACCAAGTTG<br>TGCTGAGCCCAGCAAGGGAAGGTCCCCAAACAAACCAGGAACGTTTCT<br>GAAGGTGTCTGTGTCACAGTGGAGTATAGCAGCTGTGTAGCAGAGCGA<br>TAGTCGACTGGTTCGACCCCTGGGGCCAGGGAACCCTGGTCACCGTCT<br>CCTCAGGTGAGTCCTCACCACCCCCTCTCTGAGTCCACTTAGGGAGAC<br>TCAGCTTGCCAGGTGTAGCAGAGCGATACTGATGGCGCGAGGGAGGC | SEQ ID NO:<br>5790 |
| hsIGH_2213_D024_J008_IGHD6-<br>13_IGHJp2 | GCCTTGCCAGCCCGCTCAGTGGCAGTTGAGCGATAAGGCAGCTGACCC<br>CTGACTTGGACCCCTATTCCAGACACCAGACAGAGGCGCAGGCCCCCC<br>AGAACCAGGGTTGAGGGACGCCCCGTCAAAGCCAGACAAAACCAAGGG<br>GTGTTGAGCCCAGCAAGGGAAGGCCCCCAAACAGACCAGGAGGTTTCT<br>GAAGGTGTCTGTGTCACAGTGGGGTATAGCAGCTTGGCAGTTGAG<br>CGATAGTCGACTGGTTCGACCCCTGGGGCCAGGGAACCCTGGTCACCG<br>TCTCCTCAGGTGAGTCCTCACCACCCCCTCTCTGAGTCCACTTAGGGA<br>GACTCAGCTTGCCAGTGGCAGTTGAGCGATACTGATGGCGCGAGGGAG<br>GC | SEQ ID NO:<br>5791 |
| hsIGH_2214_D025_J008_IGHD6-<br>19_IGHJp2 | GCCTTGCCAGCCCGCTCAGCAGTCCAAGAGCGATATGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAAGAG<br>CGATAGTCGACTGGTTCGACCCCTGGGGCCAGGGAACCCTGGTCACCG<br>TCTCCTCAGGTGAGTCCTCACCACCCCCTCTCTGAGTCCACTTAGGGA<br>GACTCAGCTTGCCAGCAGTCCAAGAGCGATACTGATGGCGCGAGGGAG<br>GC | SEQ ID NO:<br>5792 |
| hsIGH_2215_D026_J008_IGHD6-<br>25_IGHJp2 | GCCTTGCCAGCCCGCTCAGTACGTACGGAGCGATACAGCTGGCCTCTG<br>TCTCGGACCCCCATTCCAGACACCAGACAGAGGGACAGGCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGGAGCGA<br>TAGTCGACTGGTTCGACCCCTGGGGCCAGGGAACCCTGGTCACCGTCT<br>CCTCAGGTGAGTCCTCACCACCCCCTCTCTGAGTCCACTTAGGGAGAC<br>TCAGCTTGCCAGTACGTACGGAGCGATACTGATGGCGCGAGGGAGGC | SEQ ID NO:<br>5793 |
| hsIGH_2216_D027_J008_IGHD7-<br>27_IGHJp2 | GCCTTGCCAGCCCGCTCAGAGTACCGAGAGCGATAAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT | SEQ ID NO:<br>5794 |

INFORMAL SEQUENCE LISTING

| | | |
|---|---|---|
| | GGCTGAGCTGAGAACCACTGTGCTAACTAGTACCGAGAGCGATAGTCG<br>ACTGGTTCGACCCCTGGGGCCAGGGAACCCTGGTCACCGTCTCCTCAG<br>GTGAGTCCTCACCACCCCCTCTCTGAGTCCACTTAGGGAGACTCAGCT<br>TGCCAGAGTACCGAGAGCGATACTGATGGCGCGAGGGAGGC | |
| hsIGH_2217_D001_J009_IGHD1-<br>01_IGHJp3 | GCCTTGCCAGCCCGCTCAGGACACTCTGCATCTGAGCCCCGGTCTCTG<br>TGGGTGTTCCGCTAACTGGGGCTCCCAGTGCTCACCCCACAACTAAAG<br>CGAGCCCCAGCCTCCAGAGCCCCCGAAGGAGATGCCGCCCACAAGCCC<br>AGCCCCCATCCAGGAGGCCCCAGAGCTCAGGGCGCCGGGGCAGATTCT<br>GAACAGCCCCGAGTCACGGTGGGTACAACTGGAGACACTCTGCATCTG<br>AGTCGACTACTACTACTACTACATGGACGTCTGGGGCAAAGGGACCAC<br>GGTCACCGTCTCCTCAGGTAAGAATGGCCACTCTAGGGCCTTTGTTTT<br>CTGCTACTGCCGACACTCTGCATCTGACTGATGGCGCGAGGGAGGC | SEQ ID NO:<br>5795 |
| hsIGH_2218_D002_J009_IGHD1-<br>07_IGHJp3 | GCCTTGCCAGCCCGCTCAGTTCGGAACGCATCTGAGGCCTCGGTCTCT<br>GTGGGTGTTCCGCTAGCTGGGGCTCACAGTGCTCACCCCACACCTAAA<br>ACGAGCCACAGCCTCAGAGCCCTGAAGGAGACCCCGCCCACAAGCCC<br>AGCCCCCACCCAGGAGGCCCCAGAGCACAGGGCGCCCCGTCGGATTCT<br>GAACAGCCCCGAGTCACAGTGGGTATAACTGGATTCGGAACGCATCTG<br>AGTCGACTACTACTACTACTACATGGACGTCTGGGGCAAAGGGACCAC<br>GGTCACCGTCTCCTCAGGTAAGAATGGCCACTCTAGGGCCTTTGTTTT<br>CTGCTACTGCCTTCGGAACGCATCTGACTGATGGCGCGAGGGAGGC | SEQ ID NO:<br>5796 |
| hsIGH_2219_D003_J009_IGHD1-<br>14_IGHJp3 | GCCTTGCCAGCCCGCTCAGAAGTAACGGCATCTGAGGCCTCGGTCTCT<br>GTGGGTGTTCCGCTAGCTGGGGCTCACAGTGCTCACCCCACACCTAAA<br>ATGAGCCACAGCCTCCGGAGCCCCCGCAGAGACCCCGCCCACAAGCCC<br>AGCCCCCACCCAGGAGGCCCCAGAGCTCAGGGCGCCCCGTCGGATTCC<br>GAACAGCCCCGAGTCACAGCGGGTATAACCGGAAAGTAACGGCATCTG<br>AGTCGACTACTACTACTACTACATGGACGTCTGGGGCAAAGGGACCAC<br>GGTCACCGTCTCCTCAGGTAAGAATGGCCACTCTAGGGCCTTTGTTTT<br>CTGCTACTGCCAAGTAACGGCATCTGACTGATGGCGCGAGGGAGGC | SEQ ID NO:<br>5797 |
| hsIGH_2220_D004_J009_IGHD1-<br>20_IGHJp3 | GCCTTGCCAGCCCGCTCAGGTCTCCTAGCATCTGAGTCTCTGTGGGTG<br>TTCCGCTAGCTGGGGCCCCCAGTGCTCACCCCACACCTAAAGCGAGCC<br>CCAGCCTCCAGAGCCCCCTAAGCATTCCCCGCCCAGCAGCCCAGCCCC<br>TGCCCCCACCCAGGAGGCCCCAGAGCTCAGGGCGCCTGGTCGGATTCT<br>GAACAGCCCCGAGTCACAGTGGGTATAACTGGAGTCTCCTAGCATCTG<br>AGTCGACTACTACTACTACTACATGGACGTCTGGGGCAAAGGGACCAC<br>GGTCACCGTCTCCTCAGGTAAGAATGGCCACTCTAGGGCCTTTGTTTT<br>CTGCTACTGCCGTCTCCTAGCATCTGACTGATGGCGCGAGGGAGGC | SEQ ID NO:<br>5798 |
| hsIGH_2221_D005_J009_IGHD1-<br>26_IGHJp3 | GCCTTGCCAGCCCGCTCAGAGTGTCGCATCTGAAGGCCTCAGGCTC<br>TGTGGGTGCCGCTAGCTGGGGCTGCCAGTCCTCACCCCACACCTAAGG<br>TGAGCCACAGCCGCCAGAGCCTCCACAGGAGACCCCACCCAGCAGCCC<br>AGCCCCTACCCAGGAGGCCCCAGAGCTCAGGGCGCCTGGGTGGATTCT<br>GAACAGCCCCGAGTCACGGTGGGTATAGTGGGAGCTAGAGTGTCGCAT<br>CTGAGTCGACTACTACTACTACTACATGGACGTCTGGGGCAAAGGGAC<br>CACGGTCACCGTCTCCTCAGGTAAGAATGGCCACTCTAGGGCCTTTGT<br>TTTCTGCTACTGCCAGAGTGTCGCATCTGACTGATGGCGCGAGGGAGG<br>C | SEQ ID NO:<br>5799 |
| hsIGH_2222_D006_J009_IGHD2-<br>02_IGHJp3 | GCCTTGCCAGCCCGCTCAGGTTCCGAAGCATCTGAAAAGGAGGAGCCC<br>CCTGTACAGCACTGGGCTCAGAGTCCTCTCCCACACACCCTGAGTTTC<br>AGACAAAAACCCCCTGGAAATCATAGTATCAGCAGGAGAACTAGCCAG<br>AGACAGCAAGAGGGGACTCAGTGACTCCCGCGGGGACAGGAGGATTTT<br>GTGGGGGCTCGTGTCACTGTGAGGATATTGTAGTAGTACCAGCTGCTG<br>TTCCGAAGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTTCTGCTACTGCCGTTCCGAAGCATCTGACTGATGG<br>CGCGAGGGAGGC | SEQ ID NO:<br>5800 |
| hsIGH_2223_D007_J009_IGHD2-<br>08_IGHJp3 | GCCTTGCCAGCCCGCTCAGCGTTACTTGCATCTGAAAAGGAGGAGCCC<br>CTTGTTCAGCACTGGGCTCAGAGTCCTCTCCAAGACACCCAGAGTTTC<br>AGACAAAAACCCCCTGGAATGCACAGTCTCAGCAGGAGAGCCAGCCAG<br>AGCCAGCAAGATGGGGCTCAGTGACACCCGCAGGGACAGGAGGATTTT<br>GTGGGGGCTCGTGTCACTGTGAGGATATTGTACTAATGGTGTATGCTC<br>GTTACTTGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTTCTGCTACTGCCCGTTACTTGCATCTGACTGATGG<br>CGCGAGGGAGGC | SEQ ID NO:<br>5801 |
| hsIGH_2224_D008_J009_IGHD2-<br>15_IGHJp3 | GCCTTGCCAGCCCGCTCAGTAGGAGACGCATCTGAAAAGGAGGAGCCC<br>CCTATACAGCACTGGGCTCAGAGTCCTCTCTGAGACACCCTGAGTTTC<br>AGACAACAACCCGCTGGAATGCACAGTCTCAGCAGGAGAACAGACCAA<br>AGCCAGCAAAGGGACCTCGGTGACACCAGTAGGGACAGGAGGATTTT<br>GTGGGGGCTCGTGTCACTGTGAGGATATTGTAGTGGTGGTAGCTGCTT<br>AGGAGACGCATCTGAGTCGACTACTACTACTACATGGACGTCTGG | SEQ ID NO:<br>5802 |

| INFORMAL SEQUENCE LISTING | | |
|---|---|---|
| | GGCAAAGGGACCACGGTCACCGTCTCCTCAGGTAAGAATGGCCACTCT<br>AGGGCCTTTGTTTTCTGCTACTGCCTAGGAGACGCATCTGACTGATGG<br>CGCGAGGGAGGC | |
| hsIGH_2225_D009_J009_IGHD2-21_IGHJp3 | GCCTTGCCAGCCCGCTCAGGTGTCTACGCATCTGAAGCCCCCTGTACA<br>GCACTGGGCTCAGAGTCCTCTCTGAGACAGGCTCAGTTTCAGACAACA<br>ACCCGCTGGAATGCACAGTCTCAGCAGGAGAGCCAGGCCAGAGCCAGC<br>AAGAGGAGACTCGGTGACACCAGTCTCCTGTAGGGACAGGAGGATTTT<br>GTGGGGGTTCGTGTCACTGTGAGCATATTGTGGTGGTGACTGCTGTGT<br>CTACGCATCTGAGTCGACTACTACTACTACATGGACGTCTGGGGC<br>AAAGGGACCACGGTCACCGTCTCCTCAGGTAAGAATGGCCACTCTAGG<br>GCCTTTGTTTTCTGCTACTGCCGTGTCTACGCATCTGACTGATGGCGC<br>GAGGGAGGC | SEQ ID NO:<br>5803 |
| hsIGH_2226_D010_J009_IGHD3-03_IGHJp3 | GCCTTGCCAGCCCGCTCAGTGCTACACGCATCTGAGTGGGCACGGACA<br>CTGTCCACCTAAGCCAGGGGCAGACCCGAGTGTCCCCGCAGTAGACCT<br>GAGAGCGCTGGGCCCACAGCCTCCCCTCGGTGCCCTGCTACCTCCTCA<br>GGTCAGCCCTGGACATCCCGGGTTTCCCCAGGCTGGCGGTAGGTTTGG<br>GGTGAGGTCTGTGTCACTGTGGTATTACGATTTTTGGAGTGGTTATTT<br>GCTACACGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTTCTGCTACTGCCTGCTACACGCATCTGACTGATGG<br>CGCGAGGGAGGC | SEQ ID NO:<br>5804 |
| hsIGH_2227_D011_J009_IGHD3-09_IGHJp3 | GCCTTGCCAGCCCGCTCAGAACTGCCAGCATCTGATGGGCACGGACAC<br>TATCCACATAAGCGAGGGATAGACCCGAGTGTCCCCACAGCAGACCTG<br>AGAGCGCTGGGCCCACAGCCTCCCCTCAGAGCCCTGCTGCCTCCTCCG<br>GTCAGCCCTGGACATCCCCAGGTTTCCCCAGGCCTGCCGGTAGGTTTAG<br>AATGAGGTCTGTGTCACTGTGGTATTACGATATTTTGACTGGTTATTA<br>ACTGCCAGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTTCTGCTACTGCCAACTGCCAGCATCTGACTGATGG<br>CGCGAGGGAGGC | SEQ ID NO:<br>5805 |
| hsIGH_2228_D012_J009_IGHD3-10_IGHJp3 | GCCTTGCCAGCCCGCTCAGTTGGACTGGCATCTGACGATATTTTGACT<br>GGTTATTATAACCACAGTGTCACAGAGTCCATCAAAAACCCATGCCTG<br>GAAGCTTCCCGCCACAGCCCTCCCCATGGGGCCCTGCTGCCTCCTCAG<br>GTCAGCCCCGGACATCCCGGGTTTCCCCAGGCTGGGCGGTAGGTTTGG<br>GGTGAGGTCTGTGTCACTGTGGTATTACTATGGTTCGGGGAGTTATTT<br>TGGACTGGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTTCTGCTACTGCCTTGGACTGGCATCTGACTGATGG<br>CGCGAGGGAGGC | SEQ ID NO:<br>5806 |
| hsIGH_2229_D013_J009_IGHD3-16_IGHJp3 | GCCTTGCCAGCCCGCTCAGGTAGACACGCATCTGATGGACGCGGACAC<br>TATCCACATAAGCGAGGGACAGACCCGAGTGTTCCTGCAGTAGACCTG<br>AGAGCGCTGGGCCCACAGCCTCCCCTCGGTGCCCTGCTGCCTCCTCAG<br>GTCAGCCCTGGACATCCCGGGTTTCCCCAGGCCAGATGGTAGGTTTGA<br>AGTGAGGTCTGTGTCACTGTGGTATTATGATTACGTTTGGGGAGTTA<br>TCGTTGTAGACACGCATCTGAGTCGACTACTACTACTACATGGAC<br>GTCTGGGGCAAAGGGACCACGGTCACCGTCTCCTCAGGTAAGAATGGC<br>CACTCTAGGGCCTTTGTTTTCTGCTACTGCCGTAGACACGCATCTGAC<br>TGATGGCGCGAGGGAGGC | SEQ ID NO:<br>5807 |
| hsIGH_2230_D014_J009_IGHD3-22_IGHJp3 | GCCTTGCCAGCCCGCTCAGCACTGTACGCATCTGATGGGCATGGACAG<br>TGTCCACCTAAGCGAGGGACAGACCCGAGTGTCCCTGCAGTAGACCTG<br>AGAGCGCTGGGCCCACAGCCTCCCCTCGGGGCCCTGCTGCCTCCTCAG<br>GTCAGCCCTGGACATCCCGGGTTTCCCCAGGCCTGGCGGTAGGTTTGA<br>AGTGAGGTCTGTGTCACTGTGGTATTACTATGATAGTAGTGGTTATTC<br>ACTGTACGCATCTGAGTCGACTACTACTACTACATGGACGTCTGG<br>GGCAAAGGGACCACGGTCACCGTCTCCTCAGGTAAGAATGGCCACTCT<br>AGGGCCTTTGTTTCTGCTACTGCCCACTGTACGCATCTGACTGATGG<br>CGCGAGGGAGGC | SEQ ID NO:<br>5808 |
| hsIGH_2231_D015_J009_IGHD4-04_IGHJp3 | GCCTTGCCAGCCCGCTCAGGATGATCCGCATCTGACAAGGGTGAGTCA<br>GACCCTCCTGCCCTCGATGGCAGGCGGGAGAAGATTCAGAAAGGTCTGA<br>GATCCCCAGGACGCAGCACCACTGTCAATGGGGGCCCCAGACGCCTGG<br>ACCAGGGCCTGCGTGGGAAAGGCCTCTGGGCACACTCAGGGGCTTTTT<br>GTGAAGGGTCCTCCTACTGTGTGACTACAGTAGATGATCCGCATCTGA<br>GTCGACTACTACTACTACATGGACGTCTGGGGCAAAGGGACCACG<br>GTCACCGTCTCCTCAGGTAAGAATGGCCACTCTAGGGCCTTTGTTTTC<br>TGCTACTGCCGATGATCCGCATCTGACTGATGGCGCGAGGGAGGC | SEQ ID NO:<br>5809 |
| hsIGH_2232_D016_J009_IGHD4-11_IGHJp3 | GCCTTGCCAGCCCGCTCAGCGCCAATAGCATCTGATGCCTCTCTCCCC<br>AGTGGACACCCTCTTCCAGGACAGTCCTCAGTGGCATCACAGCGGCCT<br>GAGATCCCCAGGACGCAGCACCGCTGTCAATAGGGGCCCCAAATGCCT<br>GGACCAGGGCCTGCGTGGGAAAGGTCTCTGGCCACACTCGGGCTTTTT | SEQ ID NO:<br>5810 |

-continued

| INFORMAL SEQUENCE LISTING | | |
|---|---|---|
| | GTGAAGGGCCCTCCTGCTGTGTGACTACAGTACGCCAATAGCATCTGA GTCGACTACTACTACTACATGGACGTCTGGGGCAAAGGGACCACG GTCACCGTCTCCTCAGGTAAGAATGGCCACTCTAGGGCCTTTGTTTTC TGCTACTGCCCGCCAATAGCATCTGACTGATGGCGCGAGGGAGGC | |
| hsIGH_2233_D017_J009_IGHD4-17_IGHJp3 | GCCTTGCCAGCCCGCTCAGTCAAGCCTGCATCTGAGGAGGGTGAGTCA GACCCACCTGCCCTCGATGGCAGGCGGGGAAGATTCAGAAAGGCCTGA GATCCCCAGGACGCAGCACCACTGTCAATGGGGGCCCCAGACGCCTGG ACCAGGGCCTGCGTGGGAAAGGCCGCTGGGCACACTCAGGGGCTTTTT GTGAAGGCCCCTCCTACTGTGTGACTACGGTGTCAAGCCTGCATCTGA GTCGACTACTACTACTACATGGACGTCTGGGGCAAAGGGACCACG GTCACCGTCTCCTCAGGTAAGAATGGCCACTCTAGGGCCTTTGTTTTC TGCTACTGCCTCAAGCCTGCATCTGACTGATGGCGCGAGGGAGGC | SEQ ID NO: 5811 |
| hsIGH_2234_D018_J009_IGHD4-23_IGHJp3 | GCCTTGCCAGCCCGCTCAGACGTGTGTGCATCTGAGGAGGGTGAGTCA GACCCACCTGCCCTCAATGGCAGGCGGGGAAGATTCAGAAAGGCCTGA GATCCCCAGGACGCAGCACCACTGTCAATGGGGGCCCCAGACGCCTGG ACCAGGGCCTGTGTGGGAAAGGCCTCTGGCCACACTCAGGGGCTTTTT GTGAAGGGCCCTCCTGCTGTGTGACTACGGTGGTAACGTGTGTGCATC TGAGTCGACTACTACTACTACATGGACGTCTGGGGCAAAGGGACC ACGGTCACCGTCTCCTCAGGTAAGAATGGCCACTCTAGGGCCTTTGTT TTCTGCTACTGCCACGTGTGTGCATCTGACTGATGGCGCGAGGGAGGC | SEQ ID NO: 5812 |
| hsIGH_2235_D019_J009_IGHD5-05_IGHJp3 | GCCTTGCCAGCCCGCTCAGTCCGTCTAGCATCTGAAGAGGCCTCTCCA GGGGGACACTGTGCATGTCTGGTCCCTGAGCAGCCCCCATGTCCCCA GTCCTGGGGGCCCCTGGCACAGCTGTCTGGACCCTCTCTATTCCCT GGGAAGCTCCTCCTGACAGCCCCGCCTCCAGTTCCAGGTGTGGTTATT GTCAGGGGGTGTCAGACTGTGGTGGATACAGCTATGTCCGTCTAGCAT CTGAGTCGACTACTACTACTACTACATGGACGTCTGGGGCAAAGGGAC CACGGTCACCGTCTCCTCAGGTAAGAATGGCCACTCTAGGGCCTTTGT TTTCTGCTACTGCCTCCGTCTAGCATCTGACTGATGGCGCGAGGGAGG C | SEQ ID NO: 5813 |
| hsIGH_2236_D020_J009_IGHD5-12_IGHJp3 | GCCTTGCCAGCCCGCTCAGAAGAGCTGGCATCTGAGCAGAGGCCTCTC CAGGGAGACACTGTGCATGTCTGGTACCTAAGCAGCCCCCACGTCCC CAGTCCTGGGGGCCCCTGGCTCAGCTGTCTGGACCCTCCCTGTTCCCT GGGAAGCTCCTCCTGACAGCCCCGCCTCCAGTTCCAGGTGTGGTTATT GTCAGGCGATGTCAGACTGTGGTGGATATAGTGGCTACGAAGAGCTGG CATCTGAGTCGACTACTACTACTACTACATGGACGTCTGGGGCAAAGG GACCACGGTCACCGTCTCCTCAGGTAAGAATGGCCACTCTAGGGCCTT TGTTTTCTGCTACTGCCAAGAGCTGGCATCTGACTGATGGCGCGAGGG AGGC | SEQ ID NO: 5814 |
| hsIGH_2237_D021_J009_IGHD5-18_IGHJp3 | GCCTTGCCAGCCCGCTCAGTATCGCTCGCATCTGAGCAGAGGCCTCTC CAGGGGGACACTGTGCATGTCTGGTCCCTGAGCAGCCCCCACGTCCC CAGTCCTGGGGGCCCCTGGCACAGCTGTCTGGACCCTCCCTGTTCCCT GGGAAGCTCCTCCTGACAGCCCCGCCTCCAGTTCCAGGTGTGGTTATT GTCAGGGGGTGTCAGACTGTGGTGGATACAGCTATGTATCGCTCGCAT CTGAGTCGACTACTACTACTACTACATGGACGTCTGGGGCAAAGGGAC CACGGTCACCGTCTCCTCAGGTAAGAATGGCCACTCTAGGGCCTTTGT TTTCTGCTACTGCCTATCGCTCGCATCTGACTGATGGCGCGAGGGAGG C | SEQ ID NO: 5815 |
| hsIGH_2238_D022_J009_IGHD5-24_IGHJp3 | GCCTTGCCAGCCCGCTCAGTCAGATGCGCATCTGAGCAGAGGCCTCTC CAGGGGGACACAGTGCATGTCTGGTCCCTGAGCAGCCCCCAGGCTCTC TAGCACTGGGGGCCCCTGGCACAGCTGTCTGGACCCTCCCTGTTCCCT GGGAAGCTCCTCCTGACAGCCCCGCCTCCAGTTCCAGGTGTGGTTATT GTCAGGGGGTGCAGGCCGTGGTAGAGATGGCTACATCAGATGCGCAT CTGAGTCGACTACTACTACTACTACATGGACGTCTGGGGCAAAGGGAC CACGGTCACCGTCTCCTCAGGTAAGAATGGCCACTCTAGGGCCTTTGT TTTCTGCTACTGCCTCAGATGCGCATCTGACTGATGGCGCGAGGGAGG C | SEQ ID NO: 5816 |
| hsIGH_2239_D023_J009_IGHD6-06_IGHJp3 | GCCTTGCCAGCCCGCTCAGGTGTAGCAGCATCTGAAGGCAGCTGACTC CTGACTTGGACGCCTATTCCAGACACCAGACAGAGGGGCAGGCCCCCC AGAACCAGGGATGAGGACGCCCCGTCAAGGCCAGAAAAAGACCAAGTTG TGCTGAGCCCAGCAAGGGAAGGTCCCCAAACAAACCAGGAACGTTTCT GAAGGTGTCTGTGTCACAGTGGAGTATAGCAGCTGTGTAGCAGCATCT GAGTCGACTACTACTACTACTACATGGACGTCTGGGGCAAAGGGACCA CGGTCACCGTCTCCTCAGGTAAGAATGGCCACTCTAGGGCCTTTGTTT TCTGCTACTGCCGTGTAGCAGCATCTGACTGATGGCGCGAGGGAGGC | SEQ ID NO: 5817 |
| hsIGH_2240_D024_J009_IGHD6-13_IGHJp3 | GCCTTGCCAGCCCGCTCAGTGGCAGTTGCATCTGAAGGCAGCTGACCC CTGACTTGGACCCCTATTCCAGACACCAGACAGAGGCGCAGGCCCCCC AGAACCAGGGTTGAGGGACGCCCCGTCAAAGCCAGACAAAACCAAGGG GTGTTGAGCCCAGCAAGGGAAGGCCCCCAAACAGACCAGGAGGTTTCT GAAGGTGTCTGTGTCACAGTGGGGTATAGCAGCAGCTTGGCAGTTGCA | SEQ ID NO: 5818 |

| INFORMAL SEQUENCE LISTING | | |
|---|---|---|
| | TCTGAGTCGACTACTACTACTACATGGACGTCTGGGGCAAAGGGA<br>CCACGGTCACCGTCTCCTCAGGTAAGAATGGCCACTCTAGGGCCTTTG<br>TTTTCTGCTACTGCCTGGCAGTTGCATCTGACTGATGGCGCGAGGGAG<br>GC | |
| hsIGH_2241_D025_J009_IGHD6-<br>19_IGHJp3 | GCCTTGCCAGCCCGCTCAGCAGTCCAAGCATCTGATGAGGTAGCTGGC<br>CTCTGTCTCGGACCCCACTCCAGACACCAGACAGAGGGGCAGGCCCCC<br>CAAAACCAGGGTTGAGGGATGATCCGTCAAGGCAGACAAGACCAAGGG<br>GCACTGACCCCAGCAAGGGAAGGCTCCCAAACAGACGAGGAGGTTTCT<br>GAAGCTGTCTGTATCACAGTGGGGTATAGCAGTGGCTCAGTCCAAGCA<br>TCTGAGTCGACTACTACTACTACATGGACGTCTGGGGCAAAGGGA<br>CCACGGTCACCGTCTCCTCAGGTAAGAATGGCCACTCTAGGGCCTTTG<br>TTTTCTGCTACTGCCCAGTCCAAGCATCTGACTGATGGCGCGAGGGAG<br>GC | SEQ ID NO:<br>5819 |
| hsIGH_2242_D026_J009_IGHD6-<br>25_IGHJp3 | GCCTTGCCAGCCCGCTCAGTACGTACGGCATCTGACAGCTGGCCTCTG<br>TCTCGGACCCCCATTCCAGACACCAGACAGAGGGACAGGCCCCCCAGA<br>ACCAGTGTTGAGGGACACCCCTGTCCAGGGCAGCCAAGTCCAAGAGGC<br>GCGCTGAGCCCAGCAAGGGAAGGCCCCCAAACAAACCAGGAGGTTTCT<br>GAAGCTGTCTGTGTCACAGTCGGGTATAGCAGCGTACGTACGGCATCT<br>GAGTCGACTACTACTACTACATGGACGTCTGGGGCAAAGGGACCA<br>CGGTCACCGTCTCCTCAGGTAAGAATGGCCACTCTAGGGCCTTTGTTT<br>TCTGCTACTGCCTACGTACGGCATCTGACTGATGGCGCGAGGGAGGC | SEQ ID NO:<br>5820 |
| hsIGH_2243_D027_J009_IGHD7-<br>27_IGHJp3 | GCCTTGCCAGCCCGCTCAGAGTACCGAGCATCTGAAGGGTTGAGGGCT<br>GGGGTCTCCCACGTGTTTTGGGGCTAACAGCGGAAGGGAGAGCACTGG<br>CAAAGGTGCTGGGGGTCCCCTGAACCCGACCCGCCCTGAGACCGCAGC<br>CACATCAGCCCCCAGCCCCACAGGCCCCCTACCAGCCGCAGGGTTTTT<br>GGCTGAGCTGAGAACCACTGTGCTAACTAGTACCGAGCATCTGAGTCG<br>ACTACTACTACTACATGGACGTCTGGGGCAAAGGGACCACGGTCA<br>CCGTCTCCTCAGGTAAGAATGGCCACTCTAGGGCCTTTGTTTTCTGCT<br>ACTGCCAGTACCGAGCATCTGACTGATGGCGCGAGGGAGGC | SEQ ID NO:<br>5821 |
| Bias Control Sequences for hs-IGL | | |
| hsIGL_0001_V001_J001_IGLV01-<br>36_IGLJ1_F | GCCTTGCCAGCCCGCTCAGTAGGAGACGACACTCTGGTCCTGGGCCCAG<br>TCTGTGCTGACTCAGCCACCCTCGGTGTCTGAAGCCCCCAGGCAGAGGG<br>TCACCATCTCCTGTTCTGGAAGCAGCTCCAACATCGGAAATAATGCTGT<br>AAACTGGTACCAGCAGCTCCCAGGAAAGGCTCCCAAACTCCTCATCTAT<br>TATGATGATCTGCTGCCCTCAGGGGTCTCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTAGGAGACGACACTCTCTGATGGCGCGAGG<br>GAGGC | SEQ ID NO:<br>5822 |
| hsIGL_0002_V002_J001_IGLV01-<br>40_IGLJ1_F | GCCTTGCCAGCCCGCTCAGGTGTCTACGACACTCTCCTGGGCCCAGTCT<br>GTCGTGACGCAGCCGCCCTCAGTGTCTGGGGCCCCAGGGCAGAGGGTCA<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGTGTCTACGACACTCTCTGATGGCGCGAGG<br>GAGGC | SEQ ID NO:<br>5823 |
| hsIGL_0003_V003_J001_IGLV01-<br>44_IGLJ1_F | GCCTTGCCAGCCCGCTCAGGTACAGTGGACACTCTGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATACTGT<br>AAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGTACAGTGGACACTCTCTGATGGCGCGAGG<br>GAGGC | SEQ ID NO:<br>5824 |
| hsIGL_0004_V004_J001_IGLV01-<br>47_IGLJ1_F | GCCTTGCCAGCCCGCTCAGGGATCATCGACACTCTGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCGGTCCGAGGA | SEQ ID NO:<br>5825 |

| INFORMAL SEQUENCE LISTING | |
|---|---|
| | TGAGGCTGATTATTACTGTGCAGCATGGGATGACAGCCTGATGAGGATC<br>ATCGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGGATCATCGACACTCTCTGATGGCGCGAGG<br>GAGGC |
| hsIGL_0005_V005_J001_IGLV01-<br>50-<br>ORF_IGLJ1_F | GCCTTGCCAGCCCGCTCAGTATTGGCGGACACTCTCCTGGGCCCAGTCT SEQ ID NO:<br>GTGCTGACGCAGCCGCCCTCAGTGTCTGGGGCCCCAGGGCAGAGGGTCA 5826<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTATTGGCGGACACTCTCTGATGGCGCGAGG<br>GAGGC |
| hsIGL_0006_V006_J001_IGLV01-<br>51_IGLJ1_F | GCCTTGCCAGCCCGCTCAGAGGCTTGAGACACTCTGGTCCTGGGCCCAG SEQ ID NO:<br>TCTGTGTTGACGCAGCCGCCCTCAGTGTCTGCGGCCCCAGGACAGAAGG 5827<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTAGGCTTGAGACACTCTCTGATGGCGCGAGG<br>GAGGC |
| hsIGL_0007_V007_J001_IGLV02-<br>08_IGLJ1_F | GCCTTGCCAGCCCGCTCAGACACACGTGACACTCTGTCCTGGGCCCAGT SEQ ID NO:<br>CTGCCCTGACTCAGCCTCCCTCCGCGTCCAGGTCTCCTGGACAGTCAGT 5828<br>CACCATCTCCTGCACTGGAACCAGCAGTGACGTTGGTGGTTATAACTAT<br>GTCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTACACACGTGACACTCTCTGATGGCGCGAGG<br>GAGGC |
| hsIGL_0008_V008_J001_IGLV02-<br>11_IGLJ1_F | GCCTTGCCAGCCCGCTCAGTAGACGGAGACACTCTATCCTGGGCTCAGT SEQ ID NO:<br>CTGCCCTGACTCAGCCTCGCTCAGTGTCCGGGTCTCCTGGACAGTCAGT 5829<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTAGACGGAGACACTCTCTGATGGCGCGAGG<br>GAGGC |
| hsIGL_0009_V009_J001_IGLV02-<br>14_IGLJ1_F | GCCTTGCCAGCCCGCTCAGCAGCTCTTGACACTCTGTCCTGGGCCCAGT SEQ ID NO:<br>CTGCCCTGACTCAGCCTGCCTCCGTGTCTGGGTCTCCTGGACAGTCGAT 5830<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTCAGCTCTTGACACTCTCTGATGGCGCGAGG<br>GAGGC |
| hsIGL_0010_V010_J001_IGLV02-<br>18_IGLJ1_F | GCCTTGCCAGCCCGCTCAGGAGCGATAGACACTCTATCCTGGGCTCAGT SEQ ID NO:<br>CTGCCCTGACTCAGCCTCCCTCCGTGTCCGGGTCTCCTGGACAGTCAGT 5831<br>CACCATCTCCTGCACTGGAACCAGCAGTGACGTTGGTAGTTATAACCGT<br>GTCTCCTGGTACCAGCAGCCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGAGCGATAGACACTCTCTGATGGCGCGAGG<br>GAGGC |

INFORMAL SEQUENCE LISTING

| | | |
|---|---|---|
| hsIGL_0011_V011_J001_IGLV02-23_IGLJ1_F | GCCTTGCCAGCCCGCTCAGGCATCTGAGACACTCTGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGCATCTGAGACACTCTCTGATGGCGCGAGG<br>GAGGC | SEQ ID NO: 5832 |
| hsIGL_0012_V012_J001_IGLV02-33-ORF_IGLJ1_F | GCCTTGCCAGCCCGCTCAGTGCTACACGACACTCTGTCCTGGGCCCAGT<br>CTGCCCTGACTCAGCCTCCTTTTGTGTCCGGGGCTCCTGGACAGTCGGT<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTGCTACACGACACTCTCTGATGGCGCGAGG<br>GAGGC | SEQ ID NO: 5833 |
| hsIGL_0013_V013_J001_IGLV03-01_IGLJ1_F | GCCTTGCCAGCCCGCTCAGAACTGCCAGACACTCTCTCTCCTGTAGGAT<br>CCGTGGCCTCCTATGAGCTGACTCAGCCACCCTCAGTGTCCGTGTCCCC<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTAACTGCCAGACACTCTCTGATGGCGCGAGG<br>GAGGC | SEQ ID NO: 5834 |
| hsIGL_0014_V014_J001_IGLV03-09-FP_IGLJ1_F | GCCTTGCCAGCCCGCTCAGTTGGACTGGACACTCTTTTTCTTGCAGGTT<br>CTGTGGCCTCCTATGAGCTGACTCAGCCACTCTCAGTGTCAGTGGCCCT<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTTGGACTGGACACTCTCTGATGGCGCGAGG<br>GAGGC | SEQ ID NO: 5835 |
| hsIGL_0015_V015_J001_IGLV03-10_IGLJ1_F | GCCTTGCCAGCCCGCTCAGGTAGACACGACACTCTTTGCAGTCTCTGAG<br>GCCTCCTATGAGCTGACACAGCCACCCTCGGTGTCAGTGTCCCCAGGAC<br>AAACGGCCAGGATCACCTGCTCTGGAGATGCATTGCCAAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACAGCAGTGGTATGAGTAGA<br>CACGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGTAGACACGACACTCTCTGATGGCGCGAGG<br>GAGGC | SEQ ID NO: 5836 |
| hsIGL_0016_V016_J001_IGLV03-12_IGLJ1_F | GCCTTGCCAGCCCGCTCAGCACTGTACGACACTCTTTGCAGGCTCTGCG<br>ACCTCCTATGAGCTGACTCAGCCACACTCAGTGTCAGTGGCCACAGCAC<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTCACTGTACGACACTCTCTGATGGCGCGAGG<br>GAGGC | SEQ ID NO: 5837 |
| hsIGL_0017_V017_J001_IGLV03-16_IGLJ1_F | GCCTTGCCAGCCCGCTCAGGATGATCCGACACTCTTTGCAGGCTCTGAG<br>GCCTCCTATGAGCTGACACAGCCACCCTCGGTGTCAGTGTCCCTAGGAC<br>AGATGGCCAGGATCACCTGCTCTGGAGAAGCATTGCCAAAAAAATATGC<br>TTATTGGTACCAGCAGAAGCCAGGCCAGTTCCCTGTGCTGGTGATATAT | SEQ ID NO: 5838 |

| | INFORMAL SEQUENCE LISTING | |
|---|---|---|
| | AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGATGATCCGACACTCTCTGATGGCGCGAGG<br>GAGGC | |
| hsIGL_0018_V018_J001_IGLV03-<br>19_IGLJ1_F | GCCTTGCCAGCCCGCTCAGCGCCAATAGACACTCTTTGCAGGTTCTGTG<br>GTTTCTTCTGAGCTGACTCAGGACCCTGCTGTGTCTGTGGCCTTGGGAC<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTCGCCAATAGACACTCTCTGATGGCGCGAGG<br>GAGGC | SEQ ID NO:<br>5839 |
| hsIGL_0019_V019_J001_IGLV03-<br>21_IGLJ1_F | GCCTTGCCAGCCCGCTCAGTCAAGCCTGACACTCTTTGCAGGCTCTGTG<br>ACCTCCTATGTGCTGACTCAGCCACCCTCAGTGTCAGTGGCCCCAGGAA<br>AGACGGCCAGGATTACCTGTGGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTCAAGCCTGACACTCTCTGATGGCGCGAGG<br>GAGGC | SEQ ID NO:<br>5840 |
| hsIGL_0020_V020_J001_IGLV03-<br>22-<br>FP_IGLJ1_F | GCCTTGCCAGCCCGCTCAGACGTGTGTGACACTCTCCTCTCTTGCAGGC<br>TCTGTTGCCTCCTATGAGCTGACACAGCTACCCTCGGTGTCAGTGTCCC<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTACGTGTGTGACACTCTCTGATGGCGCGAGG<br>GAGGC | SEQ ID NO:<br>5841 |
| hsIGL_0021_V021_J001_IGLV03-<br>25_IGLJ1_F | GCCTTGCCAGCCCGCTCAGTCCGTCTAGACACTCTTTGCAGGCTCTGAG<br>GCCTCCTATGAGCTGACACAGCCACCCTCGGTGTCAGTGTCCCCAGGAC<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTCCGTCTAGACACTCTCTGATGGCGCGAGG<br>GAGGC | SEQ ID NO:<br>5842 |
| hsIGL_0022_V022_J001_IGLV03-<br>27_IGLJ1_F | GCCTTGCCAGCCCGCTCAGAAGAGCTGGACACTCTCTTTTCTTGCAGTC<br>TCTGTGGCCTCCTATGAGCTGACACAGCCATCCTCAGTGTCAGTGTCTC<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTAAGAGCTGGACACTCTCTGATGGCGCGAGG<br>GAGGC | SEQ ID NO:<br>5843 |
| hsIGL_0023_V023_J001_IGLV04-<br>03_IGLJ1_F | GCCTTGCCAGCCCGCTCAGTATCGCTCGACACTCTTGCTGACTCAGCCC<br>CCGTCTGCATCTGCCTTGCTGGGAGCCTCGATCAAGCTCACCTGCACCC<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC<br>AGCAAGGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG | SEQ ID NO:<br>5844 |

| INFORMAL SEQUENCE LISTING | |
|---|---|
| | CTCGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTATCGCTCGACACTCTCTGATGGCGCGAGG<br>GAGGC |
| hsIGL_0024_V024_J001_IGLV04-60_IGLJ1_F | GCCTTGCCAGCCCGCTCAGTCAGATGCGACACTCTCTCTCTCCCAGCCT SEQ ID NO:<br>GTGCTGACTCAATCATCCTCTGCCTCTGCTTCCCTGGGATCCTCGGTCA 5845<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTCAGATGCGACACTCTCTGATGGCGCGAGG<br>GAGGC |
| hsIGL_0025_V025_J001_IGLV04-69_IGLJ1_F | GCCTTGCCAGCCCGCTCAGGTGTAGCAGACACTCTCTCTCTCCCAGCTT SEQ ID NO:<br>GTGCTGACTCAATCGCCCTCTGCCTCTGCCTCCCTGGGAGCCTCGGTCA 5846<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACAGCAAGGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGGCACTGTGAGTGTA<br>GCAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTGTGTAGCAGACACTCTCTGATGGCGCGAGG<br>GAGGC |
| hsIGL_0026_V026_J001_IGLV05-37_IGLJ1_F | GCCTTGCCAGCCCGCTCAGTGGCAGTTGACACTCTTGTGCTGACTCAGC SEQ ID NO:<br>CACCTTCCTCCTCCGCATCTCCTGGAGAATCCGCCAGACTCACCTGCAC 5847<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT<br>CAGATAAGGGCCAGGGCTCTGGAGTCCCCAGCCGCTTCTCTGGATCCAA<br>AGATGCTTCAGCCAATACAGGGATTTTACTCATCTCCGGGCTCCAGTCT<br>GAGGATGAGGCTGACTATTACTGTATGATTTGGCCAAGCAATGATGGCA<br>GTTGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTGGCAGTTGACACTCTCTGATGGCGCGAGG<br>GAGGC |
| hsIGL_0027_V027_J001_IGLV05-39_IGLJ1_F | GCCTTGCCAGCCCGCTCAGCAGTCCAAGACACTCTTGTGCTGACTCAGC SEQ ID NO:<br>CAACCTCCCTCTCAGCATCTCCTGGAGCATCAGCCAGATTCACCTGCAC 5848<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTCAGTCCAAGACACTCTCTGATGGCGCGAGG<br>GAGGC |
| hsIGL_0028_V028_J001_IGLV05-45_IGLJ1_F | GCCTTGCCAGCCCGCTCAGTACGTACGGACACTCTTGTGCTGACTCAGC SEQ ID NO:<br>CGTCTTCCCTCTCTGCATCTCCTGGAGCATCAGCCAGTCTCACCTGCAC 5849<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTTACGTACGGACACTCTCTGATGGCGCGAGG<br>GAGGC |
| hsIGL_0029_V029_J001_IGLV05-52_IGLJ1_F | GCCTTGCCAGCCCGCTCAGAGTACCGAGACACTCTTGACTCAGCCATCT SEQ ID NO:<br>TCCCATTCTGCATCTTCTGGAGCATCAGTCAGACTCACCTGCATGCTGA 5850<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT<br>AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGAGACACTCTGTCGACTCTTCGGAACTGGGACCAAGGTCACCGTCCTA<br>GGTAAGTGGCTCTCAACCTTTCCCAGCCTGTCTCACCCTCTGCTGTCCC<br>TGGAAAATCTGTTTTCTCTAGTACCGAGACACTCTCTGATGGCGCGAGG<br>GAGGC |

| INFORMAL SEQUENCE LISTING | |
|---|---|
| hsIGL_0030_V030_J001_IGLV07-43_IGLJ1_F | GCCTTGCCAGCCCGCTCAGATCCATGGGACACTCTAGGGTCCAATTCTC SEQ ID NO: AGACTGTGGTGACTCAGGAGCCCTCACTGACTGTGTCCCCAGGAGGGAC 5851 AGTCACTCTCACCTGTGCTTCCAGCACTGGAGCAGTCACCAGTGGTTAC TATCCAAACTGGTTCCAGCAGAAACCTGGACAAGCACCCAGGGCACTGA TTTATAGTACAAGCAACAAACACTCCTGGACCCCTGCCCGGTTCTCAGG CTCCCTCCTTGGGGGCAAAGCTGCCCTGACACTGTCAGGTGTGCAGCCT GAGGACGAGGCTGAGTATTACTGCCTGCTCTACTATGGTGGTAATCCA TGGGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTATCCATGGGACACTCTCTGATGGCGCGAGG GAGGC |
| hsIGL_0031_V031_J001_IGLV07-46-FP_IGLJ1_F | GCCTTGCCAGCCCGCTCAGGTAGCAGTGACACTCTAGGGTCCAATTCCC SEQ ID NO: AGGCTGTGGTGACTCAGGAGCCCTCACTGACTGTGTCCCCAGGAGGGAC 5852 AGTCACTCTCACCTGTGGCTCCAGCACTGGAGCTGTCACCAGTGGTCAT TATCCCTACTGGTTCCAGCAGAAGCCTGGCCAAGCCCCCAGGACACTGA TTTATGATACAAGCAACAAACACTCCTGGACACCTGCCCGGTTCTCAGG CTCCCTCCTTGGGGGCAAAGCTGCCCTGACCCTTTGGGTGCGCAGCCT GAGGATGAGGCTGAGTATTACTGCTTGCTCTCCTATAGTGGTGAGTAGC AGTGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTGTAGCAGTGACACTCTCTGATGGCGCGAGG GAGGC |
| hsIGL_0032_V032_J001_IGLV08-61_IGLJ1_F | GCCTTGCCAGCCCGCTCAGATCTTCGTGACACTCTGAGTGGATTCTCAG SEQ ID NO: ACTGTGGTGACCCAGGAGCCATCGTTCTCAGTGTCCCCTGGAGGGACAG 5853 TCACACTCACTTGTGGCTTGAGCTCTGGCTCAGTCTCTACTAGTTACTA CCCCAGCTGGTACCAGCAGACCCCAGGCCAGGCTCCACGCACGCTCATC TACAGCACAAACACTCGCTCTTCTGGGGTCCCTGATTGCTTCTCTGGCT CCATCCTTGGGAACAAAGCTGCCCTCACCATCACGGGGGCCCAGGCAGA TGATGAATCTGATTATTACTGTGTGCTGTATATGGGTAGTGTGAATCTT CGTGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTATCTTCGTGACACTCTCTGATGGCGCGAGG GAGGC |
| hsIGL_0033_V033_J001_IGLV09-49_IGLJ1_F | GCCTTGCCAGCCCGCTCAGTCCACAGTGACACTCTTGACTCAGCCACCT SEQ ID NO: TCTGCATCAGCCTCCCTGGGAGCCTCGGTCACACTCACCTGCACCCTGA 5854 GCAGCGGCTACAGTAATTATAAAGTGGACTGGTACCAGCAGAGACCAGG GAAGGGCCCCGGTTTGTGATGCGAGTGGGCACTGGTGGGATTGTGGGA TCCAAGGGGATGGCATCCCTGATCGCTTCTCAGTCTTGGGCTCAGGCC TGAATCGGTACCTGACCATCAAGAACATCCAGGAAGAAGATGAGAGTGA CTACCACTGTGGGGCAGACCATGGCAGTGGGAGCAACTTCGTGATCCAC AGTGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTTCCACAGTGACACTCTCTGATGGCGCGAGG GAGGC |
| hsIGL_0034_V034_J001_IGLV10-54-FP_IGLJ1_F | GCCTTGCCAGCCCGCTCAGATGACACCGACACTCTTGTCAGTGGTCCAG SEQ ID NO: GCAGGGCTGACTCAGCCACCCTCGGTCTCCAAGGGCTTGAGACAGACCG 5855 CCACACTCACCTGCACTGGGAACAGCAACAATGTTGGCAACCAAGGAGC AGCTTGGCCTGAGCAGCACCAGGGCCACCCTCCCAAACTCCTATCCTAC AGGAATAACAACCGGCCCTCAGGGATCTCAGAGAGATTATCTGCATCCA GGTCAGGAAACACAGCCTCCCTGACCATTACTGGACTCCAGCCTGAGGA CGAGGCTGACTATTACTGCTCAGCATGGGACAGCAGCCTCATGAATGAC ACCGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTATGACACCGACACTCTCTGATGGCGCGAGG GAGGC |
| hsIGL_0035_V035_J001_IGLV11-55-ORF_IGLJ1_F | GCCTTGCCAGCCCGCTCAGCTTCACGAGACACTCTCGTGCTGACTCAGC SEQ ID NO: CGCCCTCTCTGTCTGCATCCCCGGGAGCAACAGCCAGACTCCCCTGCAC 5856 CCTGAGCAGTGACCTCAGTGTTGGTGGTAAAAACATGTTCTGGTACCAG CAGAAGCCAGGGAGCTCTCCCAGGTTATTCCTGTATCACTACTCAGACT CAGACAAGCAGCTGGGACCTGGGGTCCCCAGTCGAGTCTCTGGCTCCAA GGGAGACCTCAAGTAACACAGCGTTTTTGCTCATCTCTGGGCTCCAGCCT GAGGACGAGGCCGATTATTACTGCAGGTGTACGAAAGTAGTGACTTCA CGAGACACTCTGTCGACTCTTCGGAACTGGGACCAAGGTCACCGTCCTA GGTAAGTGGCTCTCAACCTTTCCCAGCCTGTCTCACCCTCTGCTGTCCC TGGAAAATCTGTTTTCTCTCTTCACGAGACACTCTCTGATGGCGCGAGG GAGGC |
| hsIGL_0036_V001_J002_IGLV01-36_IGLJ2_F | GCCTTGCCAGCCCGCTCAGTAGGAGACTTCGGAACGGTCCTGGGCCCAG SEQ ID NO: TCTGTGCTGACTCAGCCACCCTCGGTGTCTGAAGCCCCCAGGCAGAGGG 5857 TCACCATCTCCTGTTCTGGAAGCAGCTCCAACATCGGAAATAATGCTGT AAACTGGTACCAGCAGCTCCCAGGAAAGGCTCCCAAACTCCTCATCTAT TATGATGATCTGCTGCCCTCAGGGGTCTCTGACCGATTCTCTGGCTCCA |

| INFORMAL SEQUENCE LISTING | |
|---|---|
| | AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTAGGAGACTTCGGAACCTGATGGCGCGAGG<br>GAGGC |
| hsIGL_0037_V002_J002_IGLV01-<br>40_IGLJ2_F | GCCTTGCCAGCCCGCTCAGGTGTCTACTTCGGAACCCTGGGCCCAGTCT SEQ ID NO:<br>GTCGTGACGCAGCCGCCCTCAGTGTCTGGGGCCCCAGGGCAGAGGGTCA 5858<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTGTCTACTTCGGAACCTGATGGCGCGAGG<br>GAGGC |
| hsIGL_0038_V003_J002_IGLV01-<br>44_IGLJ2_F | GCCTTGCCAGCCCGCTCAGGTACAGTGTTCGGAACGGTCCTGGGCCCAG SEQ ID NO:<br>TCTGTGCTGACTCAGCCACCCTCAGCGTCTGGGACCCCCGGGCAGAGGG 5859<br>TCACCATCTCTTGTTCTGGAAGCAGCTCCAACATCGGAAGTAATACTGT<br>AAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTACAGTGTTCGGAACCTGATGGCGCGAGG<br>GAGGC |
| hsIGL_0039_V004_J002_IGLV01-<br>47_IGLJ2_F | GCCTTGCCAGCCCGCTCAGGGATCATCTTCGGAACGGTCCTGGGCCCAG SEQ ID NO:<br>TCTGTGCTGACTCAGCCACCCTCAGCGTCTGGGACCCCCGGGCAGAGGG 5860<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCGGTCCGAGGA<br>TGAGGCTGATTATTACTGTGCAGCATGGGATGACAGCCTGATGAGGATC<br>ATCTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGGATCATCTTCGGAACCTGATGGCGCGAGG<br>GAGGC |
| hsIGL_0040_V005_J002_IGLV01-<br>50-<br>ORF_IGLJ2_F | GCCTTGCCAGCCCGCTCAGTATTGGCGTTCGGAACCCTGGGCCCAGTCT SEQ ID NO:<br>GTGCTGACGCAGCCGCCCTCAGTGTCTGGGGCCCCAGGGCAGAGGGTCA 5861<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTATTGGCGTTCGGAACCTGATGGCGCGAGG<br>GAGGC |
| hsIGL_0041_V006_J002_IGLV01-<br>51_IGLJ2_F | GCCTTGCCAGCCCGCTCAGAGGCTTGATTCGGAACGGTCCTGGGCCCAG SEQ ID NO:<br>TCTGTGTTGACGCAGCCGCCCTCAGTGTCTGCGGCCCAGGACAGAAGG 5862<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAGGCTTGATTCGGAACCTGATGGCGCGAGG<br>GAGGC |
| hsIGL_0042_V007_J002_IGLV02-<br>08_IGLJ2_F | GCCTTGCCAGCCCGCTCAGACACACGTTTCGGAACGTCCTGGGCCCAGT SEQ ID NO:<br>CTGCCCTGACTCAGCCTCCCTCCGCGTCCAGGTCTCCTGGACAGTCAGT 5863<br>CACCATCTCCTGCACTGGAACCAGCAGTGACGTTGGTGGTTATAACTAT<br>GTCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTTTCGGAACGTCGACTATTCGGCGGAGGGACCAAGCTGACCGTCCTA |

| | INFORMAL SEQUENCE LISTING |
|---|---|
| | GGTGAGTCTCTTCTCCCCTCTCCTTCCCCGCTCTTGGGACAATTTCTGC<br>TGTTTTTGTTTGTTTCTGTACACACGTTTCGGAACCTGATGGCGCGAGG<br>GAGGC |
| hsIGL_0043_V008_J002_IGLV02-<br>11_IGLJ2_F | GCCTTGCCAGCCCGCTCAGTAGACGGATTCGGAACATCCTGGGCTCAGT SEQ ID NO:<br>CTGCCCTGACTCAGCCTCGCTCAGTGTCCGGGTCTCCTGGACAGTCAGT 5864<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTAGACGGATTCGGAACCTGATGGCGCGAGG<br>GAGGC |
| hsIGL_0044_V009_J002_IGLV02-<br>14_IGLJ2_F | GCCTTGCCAGCCCGCTCAGCAGCTCTTTTCGGAACGTCCTGGGCCCAGT SEQ ID NO:<br>CTGCCCTGACTCAGCCTGCCTCCGTGTCTGGGTCTCCTGGACAGTCGAT 5865<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCAGCTCTTTTCGGAACCTGATGGCGCGAGG<br>GAGGC |
| hsIGL_0045_V010_J002_IGLV02-<br>18_IGLJ2_F | GCCTTGCCAGCCCGCTCAGGAGCGATATTCGGAACATCCTGGGCTCAGT SEQ ID NO:<br>CTGCCCTGACTCAGCCTCCCTCCGTGTCCGGGTCTCCTGGACAGTCAGT 5866<br>CACCATCTCCTGCACTGGAACCAGCAGTGACGTTGGTAGTTATAACCGT<br>GTCTCCTGGTACCAGCAGCCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGAGCGATATTCGGAACCTGATGGCGCGAGG<br>GAGGC |
| hsIGL_0046_V011_J002_IGLV02-<br>23_IGLJ2_F | GCCTTGCCAGCCCGCTCAGGCATCTGATTCGGAACGTCCTGGGCCCAGT SEQ ID NO:<br>CTGCCCTGACTCAGCCTGCCTCCGTGTCTGGGTCTCCTGGACAGTCGAT 5867<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGCATCTGATTCGGAACCTGATGGCGCGAGG<br>GAGGC |
| hsIGL_0047_V012_J002_IGLV02-<br>33-<br>ORF_IGLJ2_F | GCCTTGCCAGCCCGCTCAGTGCTACACTTCGGAACGTCCTGGGCCCAGT SEQ ID NO:<br>CTGCCCTGACTCAGCCTCCTTTTGTGTCCGGGGCTCTGGACAGTCGGT 5868<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATTCACTGCAGCTTATATTCAAGTAGTTATGATGCTA<br>CACTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTGCTACACTTCGGAACCTGATGGCGCGAGG<br>GAGGC |
| hsIGL_0048_V013_J002_IGLV03-<br>01_IGLJ2_F | GCCTTGCCAGCCCGCTCAGAACTGCCATTCGGAACCTCTCCTGTAGGAT SEQ ID NO:<br>CCGTGGCCTCCTATGAGCTGACTCAGCCACCCTCAGTGTCCGTGTCCCC 5869<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAACTGCCATTCGGAACCTGATGGCGCGAGG<br>GAGGC |

| INFORMAL SEQUENCE LISTING | | |
|---|---|---|
| hsIGL_0049_V014_J002_IGLV03-09-FP_IGLJ2_F | GCCTTGCCAGCCCGCTCAGTTGGACTGTTCGGAACTTTTCTTGCAGGTT<br>CTGTGGCCTCCTATGAGCTGACTCAGCCACTCTCAGTGTCAGTGGCCCT<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTTGGACTGTTCGGAACCTGATGGCGCGAGG<br>GAGGC | SEQ ID NO: 5870 |
| hsIGL_0050_V015_J002_IGLV03-10_IGLJ2_F | GCCTTGCCAGCCCGCTCAGGTAGACACTTCGGAACTTGCAGTCTCTGAG<br>GCCTCCTATGAGCTGACACAGCCACCCTCGGTGTCAGTGTCCCCAGGAC<br>AAACGGCCAGGATCACCTGCTCTGGAGATGCATTGCCAAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACAGCAGTGGTATGAGTAGA<br>CACTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAGACACTTCGGAACCTGATGGCGCGAGG<br>GAGGC | SEQ ID NO: 5871 |
| hsIGL_0051_V016_J002_IGLV03-12_IGLJ2_F | GCCTTGCCAGCCCGCTCAGCACTGTACTTCGGAACTTGCAGGCTCTGCG<br>ACCTCCTATGAGCTGACTCAGCCACACTCAGTGTCAGTGGCCACAGCAC<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCACTGTACTTCGGAACCTGATGGCGCGAGG<br>GAGGC | SEQ ID NO: 5872 |
| hsIGL_0052_V017_J002_IGLV03-16_IGLJ2_F | GCCTTGCCAGCCCGCTCAGGATGATCCTTCGGAACTTGCAGGCTCTGAG<br>GCCTCCTATGAGCTGACACAGCCACCCTCGGTGTCAGTGTCCCTAGGAC<br>AGATGGCCAGGATCACCTGCTCTGGAGAAGCATTGCCAAAAAAATATGC<br>TTATTGGTACCAGCAGAAGCCAGGCCAGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGATGATCCTTCGGAACCTGATGGCGCGAGG<br>GAGGC | SEQ ID NO: 5873 |
| hsIGL_0053_V018_J002_IGLV03-19_IGLJ2_F | GCCTTGCCAGCCCGCTCAGCGCCAATATTCGGAACTTGCAGGTTCTGTG<br>GTTTCTTCTGAGCTGACTCAGGACCCTGCTGTGTCTGGCCTTGGGAC<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCGCCAATATTCGGAACCTGATGGCGCGAGG<br>GAGGC | SEQ ID NO: 5874 |
| hsIGL_0054_V019_J002_IGLV03-21_IGLJ2_F | GCCTTGCCAGCCCGCTCAGTCAAGCCTTTCGGAACTTGCAGGCTCTGTG<br>ACCTCCTATGTGCTGACTCAGCCACCCTCAGTGTCAGTGGCCCCAGGAA<br>AGACGGCCAGGATTACCTGTGGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCAAGCCTTTCGGAACCTGATGGCGCGAGG<br>GAGGC | SEQ ID NO: 5875 |
| hsIGL_0055_V020_J002_IGLV03-22-FP_IGLJ2_F | GCCTTGCCAGCCCGCTCAGACGTGTGTTTCGGAACCCTCTCTTGCAGGC<br>TCTGTTGCCTCCTATGAGCTGACACAGCTACCCTCGGTGTCAGTGTCCC<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG | SEQ ID NO: 5876 |

| INFORMAL SEQUENCE LISTING | |
|---|---|
| | ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTTTCGGAACGTCGACTATTCGGCGGAGGGACCAAGCTGACCGTCCTA<br>GGTGAGTCTCTTCTCCCTCTCCTTCCCCGCTCTTGGGACAATTTCTGC<br>TGTTTTTGTTTGTTTCTGTACGTGTGTTTCGGAACCTGATGGCGCGAGG<br>GAGGC |
| hsIGL_0056_V021_J002_IGLV03-<br>25_IGLJ2_F | GCCTTGCCAGCCCGCTCAGTCCGTCTATTCGGAACTTGCAGGCTCTGAG SEQ ID NO:<br>GCCTCCTATGAGCTGACACAGCCACCCTCGGTGTCAGTGTCCCCAGGAC 5877<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCCGTCTATTCGGAACCTGATGGCGCGAGG<br>GAGGC |
| hsIGL_0057_V022_J002_IGLV03-<br>27_IGLJ2_F | GCCTTGCCAGCCCGCTCAGAAGAGCTGTTCGGAACCTTTTCTTGCAGTC SEQ ID NO:<br>TCTGTGGCCTCCTATGAGCTGACACAGCCATCCTCAGTGTCAGTGTCTC 5878<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAAGAGCTGTTCGGAACCTGATGGCGCGAGG<br>GAGGC |
| hsIGL_0058_V023_J002_IGLV04-<br>03_IGLJ2_F | GCCTTGCCAGCCCGCTCAGTATCGCTCTTCGGAACTGCTGACTCAGCCC SEQ ID NO:<br>CCGTCTGCATCTGCCTTGCTGGGAGCCTCGATCAAGCTCACCTGCACCC 5879<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC<br>AGCAAGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG<br>CTCTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTATCGCTCTTCGGAACCTGATGGCGCGAGG<br>GAGGC |
| hsIGL_0059_V024_J002_IGLV04-<br>60_IGLJ2_F | GCCTTGCCAGCCCGCTCAGTCAGATGCTTCGGAACCTCTCTCCCAGCCT SEQ ID NO:<br>GTGCTGACTCAATCATCCTCTGCCTCTGCTTCCCTGGGATCCTCGGTCA 5880<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCAGATGCTTCGGAACCTGATGGCGCGAGG<br>GAGGC |
| hsIGL_0060_V025_J002_IGLV04-<br>69_IGLJ2_F | GCCTTGCCAGCCCGCTCAGGTGTAGCATTCGGAACCTCTCTCCCAGCTT SEQ ID NO:<br>GTGCTGACTCAATCGCCCTCTGCCTCTGCCTCCCTGGGAGCCTCGGTCA 5881<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACACAGCAAGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGGCACTGTGAGTGTA<br>GCATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTGTAGCATTCGGAACCTGATGGCGCGAGG<br>GAGGC |
| hsIGL_0061_V026_J002_IGLV05-<br>37_IGLJ2_F | GCCTTGCCAGCCCGCTCAGTGGCAGTTTTCGGAACTGTGCTGACTCAGC SEQ ID NO:<br>CACCTTCCTCCTCCGCATCTCCTGGAGAATCCGCCAGACTCACCTGCAC 5882<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT<br>CAGATAAGGGCCAGGGCTCTGGAGTCCCCAGCCGCTTCTCTGGATCCAA<br>AGATGCTTCAGCCAATACAGGGATTTTACTCATCTCCGGGCTCCAGTCT<br>GAGGATGAGGCTGACTATTACTGTATGATTTGGCCAAGCAATGATGGCA |

| | INFORMAL SEQUENCE LISTING |
|---|---|
| | GTTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTGGCAGTTTTCGGAACCTGATGGCGCGAGG<br>GAGGC |
| hsIGL_0062_V027_J002_IGLV05-<br>39_IGLJ2_F | GCCTTGCCAGCCCGCTCAGCAGTCCAATTCGGAACTGTGCTGACTCAGC SEQ ID NO:<br>CAACCTCCCTCTCAGCATCTCCTGGAGCATCAGCCAGATTCACCTGCAC 5883<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCAGTCCAATTCGGAACCTGATGGCGCGAGG<br>GAGGC |
| hsIGL_0063_V028_J002_IGLV05-<br>45_IGLJ2_F | GCCTTGCCAGCCCGCTCAGTACGTACGTTCGGAACTGTGCTGACTCAGC SEQ ID NO:<br>CGTCTTCCCTCTCTGCATCTCCTGGAGCATCAGCCAGTCTCACCTGCAC 5884<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTACGTACGTTCGGAACCTGATGGCGCGAGG<br>GAGGC |
| hsIGL_0064_V029_J002_IGLV05-<br>52_IGLJ2_F | GCCTTGCCAGCCCGCTCAGAGTACCGATTCGGAACTGACTCAGCCATCT SEQ ID NO:<br>TCCCATTCTGCATCTTCTGGAGCATCAGTCAGACTCACCTGCATGCTGA 5885<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT<br>AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAGTACCGATTCGGAACCTGATGGCGCGAGG<br>GAGGC |
| hsIGL_0065_V030_J002_IGLV07-<br>43_IGLJ2_F | GCCTTGCCAGCCCGCTCAGATCCATGGTTCGGAACAGGGTCCAATTCTC SEQ ID NO:<br>AGACTGTGGTGACTCAGGAGCCCTCACTGACTGTGTCCCAGGAGGGAC 5886<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTGAATCCA<br>TGGTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATCCATGGTTCGGAACCTGATGGCGCGAGG<br>GAGGC |
| hsIGL_0066_V031_J002_IGLV07-<br>46-<br>FP_IGLJ2_F | GCCTTGCCAGCCCGCTCAGGTAGCAGTTTCGGAACAGGGTCCAATTCCC SEQ ID NO:<br>AGGCTGTGGTGACTCAGGAGCCCTCACTGACTGTGTCCCAGGAGGGAC 5887<br>AGTCACTCTCACCTGTGGCTCCAGCACTGGAGCTGTCACCAGTGGTCAT<br>TATCCCTACTGGTTCCAGCAGAAGCCTGGCCAAGCCCCCAGGACACTGA<br>TTTATGATACAAGCAACAAACACTCCTGGACACCTGCCCGGTTCTCAGG<br>CTCCCTCCTTGGGGGCAAAGCTGCCCTGACCCTTTGGGTGCGCAGCCT<br>GAGGATGAGGCTGAGTATTACTGCTTGCTCTCCTATAGTGGTGAGTAGC<br>AGTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTAGCAGTTTCGGAACCTGATGGCGCGAGG<br>GAGGC |
| hsIGL_0067_V032_J002_IGLV08-<br>61_IGLJ2_F | GCCTTGCCAGCCCGCTCAGATCTTCGTTTCGGAACGAGTGGATTCTCAG SEQ ID NO:<br>ACTGTGGTGACCCAGGAGCCATCGTTCTCAGTGTCCCCTGGAGGGACAG 5888<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC<br>TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT<br>CGTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATCTTCGTTTCGGAACCTGATGGCGCGAGG<br>GAGGC |

| INFORMAL SEQUENCE LISTING | | |
|---|---|---|
| hsIGL_0068_V033_J002_IGLV09-49_IGLJ2_F | GCCTTGCCAGCCCGCTCAGTCCACAGTTTCGGAACTGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCCACAGTTTCGGAACCTGATGGCGCGAGG<br>GAGGC | SEQ ID NO: 5889 |
| hsIGL_0069_V034_J002_IGLV10-54-FP_IGLJ2_F | GCCTTGCCAGCCCGCTCAGATGACACCTTCGGAACTGTCAGTGGTCCAG<br>GCAGGGCTGACTCAGCCACCCTCGGTCTCCAAGGGCTTGAGACAGACCG<br>CCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCTTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATGACACCTTCGGAACCTGATGGCGCGAGG<br>GAGGC | SEQ ID NO: 5890 |
| hsIGL_0070_V035_J002_IGLV11-55-ORF_IGLJ2_F | GCCTTGCCAGCCCGCTCAGCTTCACGATTCGGAACCGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCTGGTACCAG<br>CAGAAGCCAGGGAGCTCTCCCAGGTTATTCCTGTATCACTACTCAGACT<br>CAGACAAGCAGCTGGGACCTGGGGTCCCCAGTCGAGTCTCTGGCTCCAA<br>GGAGACCTCAAGTAACACAGCGTTTTTGCTCATCTCTGGGCTCCAGCCT<br>GAGGACGAGGCCGATTATTACTGCCAGGTGTACGAAAGTAGTGACTTCA<br>CGATTCGGAACGTCGACTATTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCTTCACGATTCGGAACCTGATGGCGCGAGG<br>GAGGC | SEQ ID NO: 5891 |
| hsIGL_0071_V001_J003_IGLV01-36_IGLJ3_F | GCCTTGCCAGCCCGCTCAGTAGGAGACAAGTAACGGGTCCTGGGCCCAG<br>TCTGTGCTGACTCAGCCACCCTCGGTGTCTGAAGCCCCCAGGCAGAGGG<br>TCACCATCTCCTGTTCTGGAAGCAGCTCCAACATCGGAAATAATGCTGT<br>AAACTGGTACCAGCAGCTCCCAGGAAAGGCTCCCAAACTCCTCATCTAT<br>TATGATGATCTGCTGCCCTCAGGGGTCTCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTAGGAGACAAGTAACGCTGATGGCGCGAGG<br>GAGGC | SEQ ID NO: 5892 |
| hsIGL_0072_V002_J003_IGLV01-40_IGLJ3_F | GCCTTGCCAGCCCGCTCAGGTGTCTACAAGTAACGCCTGGGCCCAGTCT<br>GTCGTGACGCAGCCGCCCTCAGTGTCTGGGGCCCCAGGGCAGAGGGTCA<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTGTCTACAAGTAACGCTGATGGCGCGAGG<br>GAGGC | SEQ ID NO: 5893 |
| hsIGL_0073_V003_J003_IGLV01-44_IGLJ3_F | GCCTTGCCAGCCCGCTCAGGTACAGTGAAGTAACGGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATACTGT<br>AAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTACAGTGAAGTAACGCTGATGGCGCGAGG<br>GAGGC | SEQ ID NO: 5894 |
| hsIGL_0074_V004_J003_IGLV01-47_IGLJ3_F | GCCTTGCCAGCCCGCTCAGGGATCATCAAGTAACGGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA | SEQ ID NO: 5895 |

-continued

INFORMAL SEQUENCE LISTING

| | | |
|---|---|---|
| | AGTCTGGCACCTCAGCCTCCCTGGCCATCAGTGGGCTCCGGTCCGAGGA<br>TGAGGCTGATTATTACTGTGCAGCATGGGATGACAGCCTGATGAGGATC<br>ATCAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGGATCATCAAGTAACGCTGATGGCGCGAGG<br>GAGGC | |
| hsIGL_0075_V005_J003_IGLV01-<br>50-<br>ORF_IGLJ3_F | GCCTTGCCAGCCCGCTCAGTATTGGCGAAGTAACGCCTGGGCCCAGTCT<br>GTGCTGACGCAGCCGCCCTCAGTGTCTGGGGCCCCAGGGCAGAGGGTCA<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTATTGGCGAAGTAACGCTGATGGCGCGAGG<br>GAGGC | SEQ ID NO:<br>5896 |
| hsIGL_0076_V006_J003_IGLV01-<br>51_IGLJ3_F | GCCTTGCCAGCCCGCTCAGAGGCTTGAAAGTAACGGGTCCTGGGCCCAG<br>TCTGTGTTGACGCAGCCGCCCTCAGTGTCTGCGGCCCCAGGACAGAAGG<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAGGCTTGAAAGTAACGCTGATGGCGCGAGG<br>GAGGC | SEQ ID NO:<br>5897 |
| hsIGL_0077_V007_J003_IGLV02-<br>08_IGLJ3_F | GCCTTGCCAGCCCGCTCAGACACACGTAAGTAACGGTCCTGGGCCCAGT<br>CTGCCCTGACTCAGCCTCCCTCCGCGTCCAGGTCTCCTGGACAGTCAGT<br>CACCATCTCCTGCACTGGAACCAGCAGTGACGTTGGTGGTTATAACTAT<br>GTCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCTGACCGTCTCTGGGCTCCAGGCTGAG<br>GATGAGGCTGATTATTACTGCAGCTCATATGCAGGCAGCAATGAACACA<br>CGTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTACACACGTAAGTAACGCTGATGGCGCGAGG<br>GAGGC | SEQ ID NO:<br>5898 |
| hsIGL_0078_V008_J003_IGLV02-<br>11_IGLJ3_F | GCCTTGCCAGCCCGCTCAGTAGACGGAAAGTAACGATCCTGGGCTCAGT<br>CTGCCCTGACTCAGCCTCGCTCAGTGTCCGGGTCTCCTGGACAGTCAGT<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCTGACCATCTCTGGGCTCCAGGCTGAG<br>GATGAGGCTGATTATTACTGCTGCTCATATGCAGGCAGCTATGATAGAC<br>GGAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTAGACGGAAAGTAACGCTGATGGCGCGAGG<br>GAGGC | SEQ ID NO:<br>5899 |
| hsIGL_0079_V009_J003_IGLV02-<br>14_IGLJ3_F | GCCTTGCCAGCCCGCTCAGCAGCTCTTAAGTAACGGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCTGACCATCTCTGGGCTCCAGGCTGAG<br>GACGAGGCTGATTATTACTGCAGCTCATATACAAGCAGCAGTGACAGCT<br>CTTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCAGCTCTTAAGTAACGCTGATGGCGCGAGG<br>GAGGC | SEQ ID NO:<br>5900 |
| hsIGL_0080_V010_J003_IGLV02-<br>18_IGLJ3_F | GCCTTGCCAGCCCGCTCAGGAGCGATAAAGTAACGATCCTGGGCTCAGT<br>CTGCCCTGACTCAGCCTCCCTCCGTGTCCGGGTCTCCTGGACAGTCAGT<br>CACCATCTCCTGCACTGGAACCAGCAGTGACGTTGGTAGTTATAACCGT<br>GTCTCCTGGTACCAGCAGCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCTGACCACCTCTGGGCTCCAGGCTGAG<br>GACGAGGCTGATTATTACTGCAGCTCATATACAAGCAGCAGTGAGAGCG<br>ATAAAGTAACGGTCGACTGTTCGGCGGAGGGACCAAGCTGACCGTCCTA | SEQ ID NO:<br>5901 |

| INFORMAL SEQUENCE LISTING | |
|---|---|
| | GGTGAGTCTCTTCTCCCCTCTCCTTCCCCGCTCTTGGGACAATTTCTGC<br>TGTTTTTGTTTGTTTCTGTGAGCGATAAAGTAACGCTGATGGCGCGAGG<br>GAGGC |
| hsIGL_0081_V011_J003_IGLV02-<br>23_IGLJ3_F | GCCTTGCCAGCCCGCTCAGGCATCTGAAAGTAACGGTCCTGGGCCCAGT SEQ ID NO:<br>CTGCCCTGACTCAGCCTGCCTCCGTGTCTGGGTCTCCTGGACAGTCGAT 5902<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGCATCTGAAAGTAACGCTGATGGCGCGAGG<br>GAGGC |
| hsIGL_0082_V012_J003_IGLV02-<br>33-<br>ORF_IGLJ3_F | GCCTTGCCAGCCCGCTCAGTGCTACACAAGTAACGGTCCTGGGCCCAGT SEQ ID NO:<br>CTGCCCTGACTCAGCCTCCTTTTGTGTCCGGGGCTCCTGGACAGTCGGT 5903<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTGCTACACAAGTAACGCTGATGGCGCGAGG<br>GAGGC |
| hsIGL_0083_V013_J003_IGLV03-<br>01_IGLJ3_F | GCCTTGCCAGCCCGCTCAGAACTGCCAAAGTAACGCTCTCCTGTAGGAT SEQ ID NO:<br>CCGTGGCCTCCTATGAGCTGACTCAGCCACCCTCAGTGTCCGTGTCCCC 5904<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAACTGCCAAAGTAACGCTGATGGCGCGAGG<br>GAGGC |
| hsIGL_0084_V014_J003_IGLV03-<br>09-<br>FP_IGLJ3_F | GCCTTGCCAGCCCGCTCAGTTGGACTGAAGTAACGTTTTCTTGCAGGTT SEQ ID NO:<br>CTGTGGCCTCCTATGAGCTGACTCAGCCACTCTCAGTGTCAGTGGCCCT 5905<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTTGGACTGAAGTAACGCTGATGGCGCGAGG<br>GAGGC |
| hsIGL_0085_V015_J003_IGLV03-<br>10_IGLJ3_F | GCCTTGCCAGCCCGCTCAGGTAGACACAAGTAACGTTGCAGTCTCTGAG SEQ ID NO:<br>GCCTCCTATGAGCTGACACAGCCACCCTCGGTGTCAGTGTCCCCAGGAC 5906<br>AAACGGCCAGGATCACCTGCTCTGGAGATGCATTGCCAAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACACAGCAGTGGTATGAGTAGA<br>CACAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTAGACACAAGTAACGCTGATGGCGCGAGG<br>GAGGC |
| hsIGL_0086_V016_J003_IGLV03-<br>12_IGLJ3_F | GCCTTGCCAGCCCGCTCAGCACTGTACAAGTAACGTTGCAGGCTCTGCG SEQ ID NO:<br>ACCTCCTATGAGCTGACTCAGCCACACTCAGTGTCAGTGGCCACAGCAC 5907<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCACTGTACAAGTAACGCTGATGGCGCGAGG<br>GAGGC |

| INFORMAL SEQUENCE LISTING | | |
|---|---|---|
| hsIGL_0087_V017_J003_IGLV03-16_IGLJ3_F | GCCTTGCCAGCCCGCTCAGGATGATCCAAGTAACGTTGCAGGCTCTGAG<br>GCCTCCTATGAGCTGACACAGCCACCCTCGGTGTCAGTGTCCCTAGGAC<br>AGATGGCCAGGATCACCTGCTCTGGAGAAGCATTGCCAAAAAAATATGC<br>TTATTGGTACCAGCAGAAGCCAGGCCAGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGATGATCCAAGTAACGCTGATGGCGCGAGG<br>GAGGC | SEQ ID NO:<br>5908 |
| hsIGL_0088_V018_J003_IGLV03-19_IGLJ3_F | GCCTTGCCAGCCCGCTCAGCGCCAATAAAGTAACGTTGCAGGTTCTGTG<br>GTTTCTTCTGAGCTGACTCAGGACCCTGCTGTGTCTGTGGCCTTGGGAC<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCGCAATAAAGTAACGCTGATGGCGCGAGG<br>GAGGC | SEQ ID NO:<br>5909 |
| hsIGL_0089_V019_J003_IGLV03-21_IGLJ3_F | GCCTTGCCAGCCCGCTCAGTCAAGCCTAAGTAACGTTGCAGGCTCTGTG<br>ACCTCCTATGTGCTGACTCAGCCACCCTCAGTGTCAGTGGCCCCAGGAA<br>AGACGGCCAGGATTACCTGTGGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCAAGCCTAAGTAACGCTGATGGCGCGAGG<br>GAGGC | SEQ ID NO:<br>5910 |
| hsIGL_0090_V020_J003_IGLV03-22-FP_IGLJ3_F | GCCTTGCCAGCCCGCTCAGACGTGTGTAAGTAACGCCTCTCTTGCAGGC<br>TCTGTTGCCTCCTATGAGCTGACACAGCTACCCTCGGTGTCAGTGTCCC<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTACGTGTGTAAGTAACGCTGATGGCGCGAGG<br>GAGGC | SEQ ID NO:<br>5911 |
| hsIGL_0091_V021_J003_IGLV03-25_IGLJ3_F | GCCTTGCCAGCCCGCTCAGTCCGTCTAAAGTAACGTTGCAGGCTCTGAG<br>GCCTCCTATGAGCTGACACAGCCACCCTCGGTGTCAGTGTCCCCAGGAC<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCCGTCTAAAGTAACGCTGATGGCGCGAGG<br>GAGGC | SEQ ID NO:<br>5912 |
| hsIGL_0092_V022_J003_IGLV03-27_IGLJ3_F | GCCTTGCCAGCCCGCTCAGAAGAGCTGAAGTAACGCTTTTCTTGCAGTC<br>TCTGTGGCCTCCTATGAGCTGACACAGCCATCCTCAGTGTCAGTGTCTC<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTAAGAGCTGAAGTAACGCTGATGGCGCGAGG<br>GAGGC | SEQ ID NO:<br>5913 |
| hsIGL_0093_V023_J003_IGLV04-03_IGLJ3_F | GCCTTGCCAGCCCGCTCAGTATCGCTCAAGTAACGTGCTGACTCAGCCC<br>CCGTCTGCATCTGCCTTGCTGGGAGCCTCGATCAAGCTCACCTGCACCC<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC | SEQ ID NO:<br>5914 |

| | INFORMAL SEQUENCE LISTING |
|---|---|
| | AGCAAGGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG<br>CTCAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTATCGCTCAAGTAACGCTGATGGCGCGAGG<br>GAGGC |
| hsIGL_0094_V024_J003_IGLV04-<br>60_IGLJ3_F | GCCTTGCCAGCCCGCTCAGTCAGATGCAAGTAACGCTCTCTCCCAGCCT SEQ ID NO:<br>GTGCTGACTCAATCATCCTCTGCCTCTGCTTCCCTGGGATCCTCGGTCA 5915<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCAGATGCAAGTAACGCTGATGGCGCGAGG<br>GAGGC |
| hsIGL_0095_V025_J003_IGLV04-<br>69_IGLJ3_F | GCCTTGCCAGCCCGCTCAGGTGTAGCAAAGTAACGCTCTCTCCCAGCTT SEQ ID NO:<br>GTGCTGACTCAATCGCCCTCTGCCTCTGCCTCCCTGGGAGCCTCGGTCA 5916<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACAGCAAGGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGGCACTGTGAGTGTA<br>GCAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTGTAGCAAAGTAACGCTGATGGCGCGAGG<br>GAGGC |
| hsIGL_0096_V026_J003_IGLV05-<br>37_IGLJ3_F | GCCTTGCCAGCCCGCTCAGTGGCAGTTAAGTAACGTGTGCTGACTCAGC SEQ ID NO:<br>CACCTTCCTCCTCCGCATCTCCTGGAGAATCCGCCAGACTCACCTGCAC 5917<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT<br>CAGATAAGGGCCAGGGCTCTGGAGTCCCCAGCCGCTTCTCTGGATCCAA<br>AGATGCTTCAGCCAATCAGGGATTTTACTCATCTCCGGGCTCCAGTCT<br>GAGGATGAGGCTGACTATTACTGTATGATTTGGCCAAGCAATGATGGCA<br>GTTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTGGCAGTTAAGTAACGCTGATGGCGCGAGG<br>GAGGC |
| hsIGL_0097_V027_J003_IGLV05-<br>39_IGLJ3_F | GCCTTGCCAGCCCGCTCAGCAGTCCAAAAGTAACGTGTGCTGACTCAGC SEQ ID NO:<br>CAACCTCCCTCTCAGCATCTCCTGGAGCATCAGCCAGATTCACCTGCAC 5918<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCAGTCCAAAAGTAACGCTGATGGCGCGAGG<br>GAGGC |
| hsIGL_0098_V028_J003_IGLV05-<br>45_IGLJ3_F | GCCTTGCCAGCCCGCTCAGTACGTACGAAGTAACGTGTGCTGACTCAGC SEQ ID NO:<br>CGTCTTCCCTCTCTGCATCTCCTGGAGCATCAGCCAGTCTCACCTGCAC 5919<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTACGTACGAAGTAACGCTGATGGCGCGAGG<br>GAGGC |
| hsIGL_0099_V029_J003_IGLV05-<br>52_IGLJ3_F | GCCTTGCCAGCCCGCTCAGAGTACCGAAAGTAACGTGACTCAGCCATCT SEQ ID NO:<br>TCCCATTCTGCATCTTCTGGAGCATCAGTCAGATCACCTGCATGCTGA 5920<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT<br>AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGAAAGTAACGGTCGACTGTTCGGCGGAGGGACCAAGCTGACCGTCCTA |

| INFORMAL SEQUENCE LISTING | |
|---|---|
| | GGTGAGTCTCTTCTCCCTCTCCTTCCCCGCTCTTGGGACAATTTCTGC<br>TGTTTTTGTTTGTTTCTGTAGTACCGAAAGTAACGCTGATGGCGCGAGG<br>GAGGC |
| hsIGL_0100_V030_J003_IGLV07-<br>43_IGLJ3_F | GCCTTGCCAGCCCGCTCAGATCCATGGAAGTAACGAGGGTCCAATTCTC<br>AGACTGTGGTGACTCAGGAGCCCTCACTGACTGTGTCCCCAGGAGGGAC<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTGAATCCA<br>TGGAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATCCATGGAAGTAACGCTGATGGCGCGAGG<br>GAGGC | SEQ ID NO:<br>5921 |
| hsIGL_0101_V031_J003_IGLV07-<br>46-<br>FP_IGLJ3_F | GCCTTGCCAGCCCGCTCAGGTAGCAGTAAGTAACGAGGGTCCAATTCCC<br>AGGCTGTGGTGACTCAGGAGCCCTCACTGACTGTGTCCCCAGGAGGGAC<br>AGTCACTCTCACCTGTGGCTCCAGCACTGGAGCTGTCACCAGTGGTCAT<br>TATCCTACTGGTTCCAGCAGAAGCCTGGCCAAGCCCCCAGGACACTGA<br>TTTATGATACAAGCAACAAACACTCCTGGACACCTGCCCGGTTCTCAGG<br>CTCCCTCCTTGGGGGCAAAGCTGCCCTGACCCTTTTGGGTGCGCAGCCT<br>GAGGATGAGGCTGAGTATTACTGCTTGCTCTCCTATAGTGGTGAGTAGC<br>AGTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTGTAGCAGTAAGTAACGCTGATGGCGCGAGG<br>GAGGC | SEQ ID NO:<br>5922 |
| hsIGL_0102_V032_J003_IGLV08-<br>61_IGLJ3_F | GCCTTGCCAGCCCGCTCAGATCTTCGTAAGTAACGGAGTGGATTCTCAG<br>ACTGTGGTGACCCAGGAGCCATCGTTCTCAGTGTCCCCTGGAGGGACAG<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC<br>TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT<br>CGTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATCTTCGTAAGTAACGCTGATGGCGCGAGG<br>GAGGC | SEQ ID NO:<br>5923 |
| hsIGL_0103_V033_J003_IGLV09-<br>49_IGLJ3_F | GCCTTGCCAGCCCGCTCAGTCCACAGTAAGTAACGTGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTTCCACAGTAAGTAACGCTGATGGCGCGAGG<br>GAGGC | SEQ ID NO:<br>5924 |
| hsIGL_0104_V034_J003_IGLV10-<br>54-<br>FP_IGLJ3_F | GCCTTGCCAGCCCGCTCAGATGACACCAAGTAACGTGTCAGTGGTCCAG<br>GCAGGGCTGACTCAGCCACCCTCGGTCTCCAAGGGCTTGAGACAGACCG<br>CCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTATGACACCAAGTAACGCTGATGGCGCGAGG<br>GAGGC | SEQ ID NO:<br>5925 |
| hsIGL_0105_V035_J003_IGLV11-<br>55-<br>ORF_IGLJ3_F | GCCTTGCCAGCCCGCTCAGCTTCACGAAAGTAACGCGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCTGGTACCAG<br>CAGAAGCCAGGGAGCTCTCCCAGGTTATTCCTGTATCACTACTCAGACT<br>CAGACAAGCAGCTGGGACCTGGGGTCCCCAGTCGAGTCTCTGGCTCCAA<br>GGGAGACCTCAAGTAACACAGCGTTTTTGCTCATCTCTGGGCTCCAGCCT<br>GAGGACGAGGCCGATTATTACTGCAGGTGTACGAAAGTAGTGACTTCA<br>CGAAAGTAACGGTCGACTGTTCGGCGGAGGGACCAAGCTGACCGTCCTA<br>GGTGAGTCTCTTCTCCCCTCTCCTTCCCCGCTCTTGGGACAATTTCTGC<br>TGTTTTTGTTTGTTTCTGTCTTCACGAAAGTAACGCTGATGGCGCGAGG<br>GAGGC | SEQ ID NO:<br>5926 |

| | INFORMAL SEQUENCE LISTING | |
|---|---|---|
| hsIGL_0106_V001_J004_IGLV01-36_IGLJ4_P | GCCTTGCCAGCCCGCTCAGTAGGAGACGTCTCCTAGGTCCTGGGCCCAG TCTGTGCTGACTCAGCCACCCTCGGTGTCTGAAGCCCCCAGGCAGAGGG TCACCATCTCCTGTTCTGGAAGCAGCTCCAACATCGGAAATAATGCTGT AAACTGGTACCAGCAGCTCCCAGGAAAGGCTCCCAAACTCCTCATCTAT TATGATGATCTGCTGCCCTCAGGGGTCTCTGACCGATTCTCTGGCTCCA AGTCTGGCACCTCAGCCTCCCTGGCCATCAGTGGGCTCCAGTCTGAGGA TGAGGCTGATTATTACTGTGCAGCATGGGATGACAGCCTGATGATAGGA GACGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGTAGGAGACGTCTCCTACTGATGGCGCGAGG GAGGC | SEQ ID NO: 5927 |
| hsIGL_0107_V002_J004_IGLV01-40_IGLJ4_P | GCCTTGCCAGCCCGCTCAGGTGTCTACGTCTCCTACCTGGGCCCAGTCT GTCGTGACGCAGCCGCCCTCAGTGTCTGGGGCCCCAGGGCAGAGGGTCA CCATCTCCTGCACTGGGAGCAGCTCCAACATCGGGGCAGGTTATGATGT ACACTGGTACCAGCAGCTTCCAGGAACAGCCCCCAAACTCCTCATCTAT GGTAACAGCAATCGGCCCTCAGGGGTCCCTGACCGATTCTCTGGCTCCA AGTCTGGCACCTCAGCCTCCCTGGCCATCACTGGGCTCCAGGCTGAGGA TGAGGCTGATTATTACTGCCAGTCCTATGACAGCAGCCTGATGAGTGTC TACGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGGTGTCTACGTCTCCTACTGATGGCGCGAGG GAGGC | SEQ ID NO: 5928 |
| hsIGL_0108_V003_J004_IGLV01-44_IGLJ4_P | GCCTTGCCAGCCCGCTCAGGTACAGTGGTCTCCTAGGTCCTGGGCCCAG TCTGTGCTGACTCAGCCACCCTCAGCGTCTGGGACCCCCGGGCAGAGGG TCACCATCTCTTGTTCTGGAAGCAGCTCCAACATCGGAAGTAATACTGT AAACTGGTACCAGCAGCTCCCAGGAACGGCCCCCAAACTCCTCATCTAT AGTAATAATCAGCGGCCCTCAGGGGTCCCTGACCGATTCTCTGGCTCCA AGTCTGGCACCTCAGCCTCCCTGGCCATCAGTGGGCTCCAGTCTGAGGA TGAGGCTGATTATTACTGTGCAGCATGGGATGACAGCCTGATGAGTACA GTGGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGGTACAGTGGTCTCCTACTGATGGCGCGAGG GAGGC | SEQ ID NO: 5929 |
| hsIGL_0109_V004_J004_IGLV01-47_IGLJ4_P | GCCTTGCCAGCCCGCTCAGGGATCATCGTCTCCTAGGTCCTGGGCCCAG TCTGTGCTGACTCAGCCACCCTCAGCGTCTGGGACCCCCGGGCAGAGGG TCACCATCTCTTGTTCTGGAAGCAGCTCCAACATCGGAAGTAATTATGT ATACTGGTACCAGCAGCTCCCAGGAACGGCCCCCAAACTCCTCATCTAT AGTAATAATCAGCGGCCCTCAGGGGTCCCTGACCGATTCTCTGGCTCCA AGTCTGGCACCTCAGCCTCCCTGGCCATCAGTGGGCTCCGGTCCGAGGA TGAGGCTGATTATTACTGTGCAGCATGGGATGACAGCCTGATGAGGATC ATCGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGGGATCATCGTCTCCTACTGATGGCGCGAGG GAGGC | SEQ ID NO: 5930 |
| hsIGL_0110_V005_J004_IGLV01-50-ORF_IGLJ4_P | GCCTTGCCAGCCCGCTCAGTATTGGCGGTCTCCTACCTGGGCCCAGTCT GTGCTGACGCAGCCGCCCTCAGTGTCTGGGGCCCCAGGGCAGAGGGTCA CCATCTCCTGCACTGGGAGCAGCTCCAACATTGGGGCGGGTTATGTTGT ACATTGGTACCAGCAGCTTCCAGGAACAGCCCCCAAACTCCTCATCTAT GGTAACAGCAATCGGCCCTCAGGGGTCCCTGACCAATTCTCTGGCTCCA AGTCTGGCACCTCAGCCTCCCTGGCCATCACTGGACTCCAGTCTGAGGA TGAGGCTGATTATTACTGCAAAGCATGGGATAACAGCCTGATGATATTG GCGGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGTATTGGCGGTCTCCTACTGATGGCGCGAGG GAGGC | SEQ ID NO: 5931 |
| hsIGL_0111_V006_J004_IGLV01-51_IGLJ4_P | GCCTTGCCAGCCCGCTCAGAGGCTTGAGTCTCCTAGGTCCTGGGCCCAG TCTGTGTTGACGCAGCCGCCCTCAGTGTCTGCGGCCCAGGACAGAAGG TCACCATCTCCTGCTCTGGAAGCAGCTCCAACATTGGGAATAATTATGT ATCCTGGTACCAGCAGCTCCCAGGAACAGCCCCCAAACTCCTCATTTAT GACAATAATAAGCGACCCTCAGGGATTCCTGACCGATTCTCTGGCTCCA AGTCTGGCACGTCAGCCACCCTGGGCATCACCGGACTCCAGACTGGGGA CGAGGCCGATTATTACTGCGGAACATGGGATAGCAGCCTGATGAAGGCT TGAGTCTCCTAGTCGACTATTTGGTGGAGGAACCCAGCTGATCATTTTA GATGAGTCTCTTCTTCCCTTTCTTTCCCTGCCAAGTTGGTGACAATTTT ATTCTGATTTCGATCTTTGAGGCTTGAGTCTCCTACTGATGGCGCGAGG GAGGC | SEQ ID NO: 5932 |
| hsIGL_0112_V007_J004_IGLV02-08_IGLJ4_P | GCCTTGCCAGCCCGCTCAGACACACGTGTCTCCTAGTCCTGGGCCCAGT CTGCCCTGACTCAGCCTCCCTCCGCGTCCAGGTCTCCTGGACAGTCAGT CACCATCTCCTGCACTGGAACCAGCAGTGACGTTGGTGGTTATAACTAT GTCTCCTGGTACCAACAGCACCCAGGCAAAGCCCCCAAACTCATGATTT | SEQ ID NO: 5933 |

INFORMAL SEQUENCE LISTING

| | | |
|---|---|---|
| | ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGACACACGTGTCTCCTACTGATGGCGCGAGG<br>GAGGC | |
| hsIGL_0113_V008_J004_IGLV02-<br>11_IGLJ4_P | GCCTTGCCAGCCCGCTCAGTAGACGGAGTCTCCTAATCCTGGGCTCAGT<br>CTGCCCTGACTCAGCCTCGCTCAGTGTCCGGGTCTCCTGGACAGTCAGT<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTAGACGGAGTCTCCTACTGATGGCGCGAGG<br>GAGGC | SEQ ID NO:<br>5934 |
| hsIGL_0114_V009_J004_IGLV02-<br>14_IGLJ4_P | GCCTTGCCAGCCCGCTCAGCAGCTCTTGTCTCCTAGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGCAGCTCTTGTCTCCTACTGATGGCGCGAGG<br>GAGGC | SEQ ID NO:<br>5935 |
| hsIGL_0115_V010_J004_IGLV02-<br>18_IGLJ4_P | GCCTTGCCAGCCCGCTCAGGAGCGATAGTCTCCTAATCCTGGGCTCAGT<br>CTGCCCTGACTCAGCCTCCCTCCGTGTCCGGGTCTCCTGGACAGTCAGT<br>CACCATCTCCTGCACTGGAACCAGCAGTGACGTTGGTAGTTATAACCGT<br>GTCTCCTGGTACCAGCAGCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGAGCGATAGTCTCCTACTGATGGCGCGAGG<br>GAGGC | SEQ ID NO:<br>5936 |
| hsIGL_0116_V011_J004_IGLV02-<br>23_IGLJ4_P | GCCTTGCCAGCCCGCTCAGGCATCTGAGTCTCCTAGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGCATCTGAGTCTCCTACTGATGGCGCGAGG<br>GAGGC | SEQ ID NO:<br>5937 |
| hsIGL_0117_V012_J004_IGLV02-<br>33-<br>ORF_IGLJ4_P | GCCTTGCCAGCCCGCTCAGTGCTACACGTCTCCTAGTCCTGGGCCCAGT<br>CTGCCCTGACTCAGCCTCCTTTTGTGTCCGGGGCTCCTGGACAGTCGGT<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTGCTACACGTCTCCTACTGATGGCGCGAGG<br>GAGGC | SEQ ID NO:<br>5938 |
| hsIGL_0118_V013_J004_IGLV03-<br>01_IGLJ4_P | GCCTTGCCAGCCCGCTCAGAACTGCCAGTCTCCTACTCTCCTGTAGGAT<br>CCGTGGCCTCCTATGAGCTGACTCAGCCACCCTCAGTGTCCGTGTCCCC<br>AGGACAGACAGCCAGCATCACCTGCTCTGGAGATAAAATTGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT | SEQ ID NO:<br>5939 |

| INFORMAL SEQUENCE LISTING | |
|---|---|
| | ATTCTGATTTCGATCTTTGAACTGCCAGTCTCCTACTGATGGCGCGAGG<br>GAGGC |
| hsIGL_0119_V014_J004_IGLV03-<br>09-<br>FP_IGLJ4_P | GCCTTGCCAGCCCGCTCAGTTGGACTGGTCTCCTATTTTCTTGCAGGTT SEQ ID NO:<br>CTGTGGCCTCCTATGAGCTGACTCAGCCACTCTCAGTGTCAGTGGCCCT 5940<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTTGGACTGGTCTCCTACTGATGGCGCGAGG<br>GAGGC |
| hsIGL_0120_V015_J004_IGLV03-<br>10_IGLJ4_P | GCCTTGCCAGCCCGCTCAGGTAGACACGTCTCCTATTGCAGTCTCTGAG SEQ ID NO:<br>GCCTCCTATGAGCTGACACAGCCACCCTCGGTGTCAGTGTCCCCAGGAC 5941<br>AAACGGCCAGGATCACCTGCTCTGGAGATGCATTGCCAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACAGCAGTGGTATGAGTAGA<br>CACGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGTAGACACGTCTCCTACTGATGGCGCGAGG<br>GAGGC |
| hsIGL_0121_V016_J004_IGLV03-<br>12_IGLJ4_P | GCCTTGCCAGCCCGCTCAGCACTGTACGTCTCCTATTGCAGGCTCTGCG SEQ ID NO:<br>ACCTCCTATGAGCTGACTCAGCCACACTCAGTGTCAGTGGCCACAGCAC 5942<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGCACTGTACGTCTCCTACTGATGGCGCGAGG<br>GAGGC |
| hsIGL_0122_V017_J004_IGLV03-<br>16_IGLJ4_P | GCCTTGCCAGCCCGCTCAGGATGATCCGTCTCCTATTGCAGGCTCTGAG SEQ ID NO:<br>GCCTCCTATGAGCTGACACAGCCACCCTCGGTGTCAGTGTCCCTAGGAC 5943<br>AGATGGCCAGGATCACCTGCTCTGGAGAAGCATTGCCAAAAAATATGC<br>TTATTGGTACCAGCAGAAGCCAGGCCAGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGATGATCCGTCTCCTACTGATGGCGCGAGG<br>GAGGC |
| hsIGL_0123_V018_J004_IGLV03-<br>19_IGLJ4_P | GCCTTGCCAGCCCGCTCAGCGCCAATAGTCTCCTATTGCAGGTTCTGTG SEQ ID NO:<br>GTTTCTTCTGAGCTGACTCAGGACCCTGCTGTGTCTGTGGCCTTGGGAC 5944<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGCGCCAATAGTCTCCTACTGATGGCGCGAGG<br>GAGGC |
| hsIGL_0124_V019_J004_IGLV03-<br>21_IGLJ4_P | GCCTTGCCAGCCCGCTCAGTCAAGCCTGTCTCCTATTGCAGGCTCTGTG SEQ ID NO:<br>ACCTCCTATGTGCTGACTCAGCCACCCTCAGTGTCAGTGGCCCCAGGAA 5945<br>AGACGGCCAGGATTACCTGTGGGGGAAACAACATTGGAAGTAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTCAAGCCTGTCTCCTACTGATGGCGCGAGG<br>GAGGC |

| | | |
|---|---|---|
| INFORMAL SEQUENCE LISTING | | |
| hsIGL_0125_V020_J004_IGLV03-22-FP_IGLJ4_P | GCCTTGCCAGCCCGCTCAGACGTGTGTGTCTCCTACCTCTCTTGCAGGC<br>TCTGTTGCCTCCTATGAGCTGACACAGCTACCCTCGGTGTCAGTGTCCC<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGACGTGTGTGTCTCCTACTGATGGCGCGAGG<br>GAGGC | SEQ ID NO:<br>5946 |
| hsIGL_0126_V021_J004_IGLV03-25_IGLJ4_P | GCCTTGCCAGCCCGCTCAGTCCGTCTAGTCTCCTATTGCAGGCTCTGAG<br>GCCTCCTATGAGCTGACACAGCCACCCTCGGTGTCAGTGTCCCCAGGAC<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTCCGTCTAGTCTCCTACTGATGGCGCGAGG<br>GAGGC | SEQ ID NO:<br>5947 |
| hsIGL_0127_V022_J004_IGLV03-27_IGLJ4_P | GCCTTGCCAGCCCGCTCAGAAGAGCTGGTCTCCTACTTTTCTTGCAGTC<br>TCTGTGGCCTCCTATGAGCTGACACAGCCATCCTCAGTGTCAGTGTCTC<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGAAGAGCTGGTCTCCTACTGATGGCGCGAGG<br>GAGGC | SEQ ID NO:<br>5948 |
| hsIGL_0128_V023_J004_IGLV04-03_IGLJ4_P | GCCTTGCCAGCCCGCTCAGTATCGCTCGTCTCCTATGCTGACTCAGCCC<br>CCGTCTGCATCTGCCTTGCTGGGAGCCTCGATCAAGCTCACCTGCACCC<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC<br>AGCAAGGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG<br>CTCGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTATCGCTCGTCTCCTACTGATGGCGCGAGG<br>GAGGC | SEQ ID NO:<br>5949 |
| hsIGL_0129_V024_J004_IGLV04-60_IGLJ4_P | GCCTTGCCAGCCCGCTCAGTCAGATGCGTCTCCTACTCTCTCCCAGCCT<br>GTGCTGACTCAATCATCCTCTGCCTCTGCTTCCCTGGGATCCTCGGTCA<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTCAGATGCGTCTCCTACTGATGGCGCGAGG<br>GAGGC | SEQ ID NO:<br>5950 |
| hsIGL_0130_V025_J004_IGLV04-69_IGLJ4_P | GCCTTGCCAGCCCGCTCAGGTGTAGCAGTCTCCTACTCTCTCCCAGCTT<br>GTGCTGACTCAATCGCCCTCTGCCTCTGCCTCCCTGGGAGCCTCGGTCA<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACAGCAAGGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGCACTGTGAGTGTA<br>GCAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGTGTAGCAGTCTCCTACTGATGGCGCGAGG<br>GAGGC | SEQ ID NO:<br>5951 |
| hsIGL_0131_V026_J004_IGLV05-37_IGLJ4_P | GCCTTGCCAGCCCGCTCAGTGGCAGTTGTCTCCTATGCTGACTCAGC<br>CACCTTCCTCCTCCGCATCTCCTGGAGAATCCGCCAGACTCACCTGCAC<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT | SEQ ID NO:<br>5952 |

-continued

| | INFORMAL SEQUENCE LISTING | |
|---|---|---|
| | CAGATAAGGGCCAGGGCTCTGGAGTCCCCAGCCGCTTCTCTGGATCCAA<br>AGATGCTTCAGCCAATACAGGGATTTTACTCATCTCCGGGCTCCAGTCT<br>GAGGATGAGGCTGACTATTACTGTATGATTTGGCCAAGCAATGATGGCA<br>GTTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTGGCAGTTGTCTCCTACTGATGGCGCGAGG<br>GAGGC | |
| hsIGL_0132_V027_J004_IGLV05-<br>39_IGLJ4_P | GCCTTGCCAGCCCGCTCAGCAGTCCAAGTCTCCTATGTGCTGACTCAGC<br>CAACCTCCCTCTCAGCATCTCCTGGAGCATCAGCCAGATTCACCTGCAC<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGCAGTCCAAGTCTCCTACTGATGGCGCGAGG<br>GAGGC | SEQ ID NO:<br>5953 |
| hsIGL_0133_V028_J004_IGLV05-<br>45_IGLJ4_P | GCCTTGCCAGCCCGCTCAGTACGTACGGTCTCCTATGTGCTGACTCAGC<br>CGTCTTCCCTCTCTGCATCTCCTGGAGCATCAGCCAGTCTCACCTGCAC<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTACGTACGGTCTCCTACTGATGGCGCGAGG<br>GAGGC | SEQ ID NO:<br>5954 |
| hsIGL_0134_V029_J004_IGLV05-<br>52_IGLJ4_P | GCCTTGCCAGCCCGCTCAGAGTACCGAGTCTCCTATGACTCAGCCATCT<br>TCCCATTCTGCATCTTCTGGAGCATCAGTCAGACTCACCTGCATGCTGA<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT<br>AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGAGTACCGAGTCTCCTACTGATGGCGCGAGG<br>GAGGC | SEQ ID NO:<br>5955 |
| hsIGL_0135_V030_J004_IGLV07-<br>43_IGLJ4_P | GCCTTGCCAGCCCGCTCAGATCCATGGGTCTCCTAAGGGTCCAATTCTC<br>AGACTGTGGTGACTCAGGAGCCCTCACTGACTGTGTCCCAGGAGGGAC<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTGAATCCA<br>TGGGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGATCCATGGGTCTCCTACTGATGGCGCGAGG<br>GAGGC | SEQ ID NO:<br>5956 |
| hsIGL_0136_V031_J004_IGLV07-<br>46-<br>FP_IGLJ4_P | GCCTTGCCAGCCCGCTCAGGTAGCAGTGTCTCCTAAGGGTCCAATTCCC<br>AGGCTGTGGTGACTCAGGAGCCCTCACTGACTGTGTCCCAGGAGGGAC<br>AGTCACTCTCACCTGTGGCTCCAGCACTGGAGCTGTCACCAGTGGTCAT<br>TATCCCTACTGGTTCCAGCAGAAGCCTGGCCAAGCCCCCAGGACACTGA<br>TTTATGATACAAGCAACAAACACTCCTGGACACCTGCCCGGTTCTCAGG<br>CTCCCTCCTTGGGGGCAAAGCTGCCCTGACCCTTTTGGGTGCGCAGCCT<br>GAGGATGAGGCTGAGTATTACTGCTTGCTCTCCTATAGTGGTGAGTAGC<br>AGTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGGTAGCAGTGTCTCCTACTGATGGCGCGAGG<br>GAGGC | SEQ ID NO:<br>5957 |
| hsIGL_0137_V032_J004_IGLV08-<br>61_IGLJ4_P | GCCTTGCCAGCCCGCTCAGATCTTCGTGTCTCCTAGAGTGGATTCTCAG<br>ACTGTGGTGACCCAGGAGCCATCGTTCTCAGTGTCCCCTGGAGGGACAG<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC<br>TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT | SEQ ID NO:<br>5958 |

| | INFORMAL SEQUENCE LISTING | |
|---|---|---|
| | CGTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGATCTTCGTGTCTCCTACTGATGGCGCGAGG<br>GAGGC | |
| hsIGL_0138_V033_J004_IGLV09-<br>49_IGLJ4_P | GCCTTGCCAGCCCGCTCAGTCCACAGTGTCTCCTATGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGTCCACAGTGTCTCCTACTGATGGCGCGAGG<br>GAGGC | SEQ ID NO:<br>5959 |
| hsIGL_0139_V034_J004_IGLV10-<br>54-<br>FP_IGLJ4_P | GCCTTGCCAGCCCGCTCAGATGACACCGTCTCCTATGTCAGTGGTCCAG<br>GCAGGGCTGACTCAGCCACCCTCGGTCTCCAAGGGCTTGAGACAGACCG<br>CCCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGATGACACCGTCTCCTACTGATGGCGCGAGG<br>GAGGC | SEQ ID NO:<br>5960 |
| hsIGL_0140_V035_J004_IGLV11-<br>55-<br>ORF_IGLJ4_P | GCCTTGCCAGCCCGCTCAGCTTCACGAGTCTCCTACGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCTGGTACCAG<br>CAGAAGCCAGGGAGCTCTCCCAGGTTATTCCTGTATCACTACTCAGACT<br>CAGACAAGCAGCTGGGACCTGGGGTCCCCAGTCGAGTCTCTGGCTCCAA<br>GGAGACCTCAAGTAACACAGCGTTTTTGCTCATCTCTGGGCTCCAGCCT<br>GAGGACGAGGCCGATTATTACTGCCAGGTGTACGAAAGTAGTGACTTCA<br>CGAGTCTCCTAGTCGACTATTTGGTGGAGGAACCCAGCTGATCATTTTA<br>GATGAGTCTCTTCTTCCCTTTCTTTCCCTGCCAAGTTGGTGACAATTTT<br>ATTCTGATTTCGATCTTTGCTTCACGAGTCTCCTACTGATGGCGCGAGG<br>GAGGC | SEQ ID NO:<br>5961 |
| hsIGL_0141_V001_J005_IGLV01-<br>36_IGLJ5_P | GCCTTGCCAGCCCGCTCAGTAGGAGACAGAGTGTCGGTCCTGGGCCCAG<br>TCTGTGCTGACTCAGCCACCCTCGGTGTCTGAAGCCCCCAGGCAGAGGG<br>TCACCATCTCCTGTTCTGGAAGCAGCTCCAACATCGGAAATAATGCTGT<br>AAACTGGTACCAGCAGCTCCCAGGAAAGGCTCCCAAACTCCTCATCTAT<br>TATGATGATCTGCTGCCCTCAGGGGTCTCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTAGGAGACAGAGTGTCCTGATGGCGCGAGG<br>GAGGC | SEQ ID NO:<br>5962 |
| hsIGL_0142_V002_J005_IGLV01-<br>40_IGLJ5_P | GCCTTGCCAGCCCGCTCAGGTGTCTACAGAGTGTCCCTGGGCCCAGTCT<br>GTCGTGACGCAGCCGCCCTCAGTGTCTGGGGCCCCAGGGCAGAGGGTCA<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGTGTCTACAGAGTGTCCTGATGGCGCGAGG<br>GAGGC | SEQ ID NO:<br>5963 |
| hsIGL_0143_V003_J005_IGLV01-<br>44_IGLJ5_P | GCCTTGCCAGCCCGCTCAGGTACAGTGAGAGTGTCGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATACTGT<br>AAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGTACAGTGAGAGTGTCCTGATGGCGCGAGG<br>GAGGC | SEQ ID NO:<br>5964 |

| INFORMAL SEQUENCE LISTING | | |
|---|---|---|
| hsIGL_0144_V004_J005_IGLV01-47_IGLJ5_P | GCCTTGCCAGCCCGCTCAGGGATCATCAGAGTGTCGGTCCTGGGCCCAG<br>TCTGTGCTGACTCAGCCACCCTCAGCGTCTGGGACCCCGGGCAGAGGG<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCGGTCCGAGGA<br>TGAGGCTGATTATTACTGTGCAGCATGGGATGACAGCCTGATGAGGATC<br>ATCAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGGATCATCAGAGTGTCCTGATGGCGCGAGG<br>GAGGC | SEQ ID NO:<br>5965 |
| hsIGL_0145_V005_J005_IGLV01-50-ORF_IGLJ5_P | GCCTTGCCAGCCCGCTCAGTATTGGCGAGAGTGTCCCTGGGCCCAGTCT<br>GTGCTGACGCAGCCGCCCTCAGTGTCTGGGGCCCCAGGGCAGAGGGTCA<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTATTGGCGAGAGTGTCCTGATGGCGCGAGG<br>GAGGC | SEQ ID NO:<br>5966 |
| hsIGL_0146_V006_J005_IGLV01-51_IGLJ5_P | GCCTTGCCAGCCCGCTCAGAGGCTTGAAGAGTGTCGGTCCTGGGCCCAG<br>TCTGTGTTGACGCAGCCGCCCTCAGTGTCTGCGGCCCCAGGACAGAAGG<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCAGGCTTGAAGAGTGTCCTGATGGCGCGAGG<br>GAGGC | SEQ ID NO:<br>5967 |
| hsIGL_0147_V007_J005_IGLV02-08_IGLJ5_P | GCCTTGCCAGCCCGCTCAGACACACGTAGAGTGTCGTCCTGGGCCCAGT<br>CTGCCCTGACTCAGCCTCCCTCCGCGTCCAGGTCTCCTGGACAGTCAGT<br>CACCATCTCCTGCACTGGAACCAGCAGTGACGTTGGTGGTTATAACTAT<br>GTCCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCACACACGTAGAGTGTCCTGATGGCGCGAGG<br>GAGGC | SEQ ID NO:<br>5968 |
| hsIGL_0148_V008_J005_IGLV02-11_IGLJ5_P | GCCTTGCCAGCCCGCTCAGTAGACGGAAGAGTGTCATCCTGGGCTCAGT<br>CTGCCCTGACTCAGCCTCGCTCAGTGTCCGGGTCTCCTGGACAGTCAGT<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTAGACGGAAGAGTGTCCTGATGGCGCGAGG<br>GAGGC | SEQ ID NO:<br>5969 |
| hsIGL_0149_V009_J005_IGLV02-14_IGLJ5_P | GCCTTGCCAGCCCGCTCAGCAGCTCTTAGAGTGTCGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCCAGCTCTTAGAGTGTCCTGATGGCGCGAGG<br>GAGGC | SEQ ID NO:<br>5970 |
| hsIGL_0150_V010_J005_IGLV02-18_IGLJ5_P | GCCTTGCCAGCCCGCTCAGGAGCGATAAGAGTGTCATCCTGGGCTCAGT<br>CTGCCCTGACTCAGCCTCCCTCCGTGTCCGGGTCTCCTGGACAGTCAGT<br>CACCATCTCCTGCACTGGAACCAGCAGTGACGTTGGTAGTTATAACCGT<br>GTCTCCTGGTACCAGCAGCCCCCAGGCACAGCCCCCAAACTCATGATTT<br>ATGAGGTCAGTAATCGGCCCTCAGGGGTCCCTGATCGCTTCTCTGGGTC | SEQ ID NO:<br>5971 |

| INFORMAL SEQUENCE LISTING | |
|---|---|
| | CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGAGCGATAAGAGTGTCCTGATGGCGCGAGG<br>GAGGC |
| hsIGL_0151_V011_J005_IGLV02-<br>23_IGLJ5_P | GCCTTGCCAGCCCGCTCAGGCATCTGAAGAGTGTCGTCCTGGGCCCAGT SEQ ID NO:<br>CTGCCCTGACTCAGCCTGCCTCCGTGTCTGGGTCTCCTGGACAGTCGAT 5972<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGCATCTGAAGAGTGTCCTGATGGCGCGAGG<br>GAGGC |
| hsIGL_0152_V012_J005_IGLV02-<br>33-<br>ORF_IGLJ5_P | GCCTTGCCAGCCCGCTCAGTGCTACACAGAGTGTCGTCCTGGGCCCAGT SEQ ID NO:<br>CTGCCCTGACTCAGCCTCCTTTTGTGTCCGGGGCTCCTGGACAGTCGGT 5973<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTGCTACACAGAGTGTCCTGATGGCGCGAGG<br>GAGGC |
| hsIGL_0153_V013_J005_IGLV03-<br>01_IGLJ5_P | GCCTTGCCAGCCCGCTCAGAACTGCCAAGAGTGTCCTCTCCTGTAGGAT SEQ ID NO:<br>CCGTGGCCTCCTATGAGCTGACTCAGCCACCCTCAGTGTCCGTGTCCCA 5974<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCAACTGCCAAGAGTGTCCTGATGGCGCGAGG<br>GAGGC |
| hsIGL_0154_V014_J005_IGLV03-<br>09-<br>FP_IGLJ5_P | GCCTTGCCAGCCCGCTCAGTTGGACTGAGAGTGTCTTTTCTTGCAGGTT SEQ ID NO:<br>CTGTGGCCTCCTATGAGCTGACTCAGCCACTCTCAGTGTCAGTGGCCCT 5975<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGAGAGTGTCGTCGACTGTTTGGTGAGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTTGGACTGAGAGTGTCCTGATGGCGCGAGG<br>GAGGC |
| hsIGL_0155_V015_J005_IGLV03-<br>10_IGLJ5_P | GCCTTGCCAGCCCGCTCAGGTAGACACAGAGTGTCTTGCAGTCTCTGAG SEQ ID NO:<br>GCCTCCTATGAGCTGACACAGCCACCCTCGGTGTCAGTGTCCCCAGGAC 5976<br>AAACGGCCAGGATCACCTGCTCTGGAGATGCATTGCCAAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGCCCAGGTGGAGGA<br>TGAAGCTGACTACTACTGTTACTCAACAGACAGCAGTGGTATGAGTAGA<br>CACAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGTAGACACAGAGTGTCCTGATGGCGCGAGG<br>GAGGC |
| hsIGL_0156_V016_J005_IGLV03-<br>12_IGLJ5_P | GCCTTGCCAGCCCGCTCAGCACTGTACAGAGTGTCTTGCAGGCTCTGCG SEQ ID NO:<br>ACCTCCTATGAGCTGACTCAGCCACACTCAGTGTCAGTGGCCACAGGAC 5977<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACAGAGTGTCGTCGACTGTTTGGTGAGGGGACGGAGCTGACCGTCCTA |

| | INFORMAL SEQUENCE LISTING |
|---|---|
| | GATGAGTCTTTTCCCCCTCCTTCCCTGGTCTCCCCAAGGTACTGGGAAA<br>TTTTCTGCTGCTTTTGTTCCACTGTACAGAGTGTCCTGATGGCGCGAGG<br>GAGGC |
| hsIGL_0157_V017_J005_IGLV03-16_IGLJ5_P | GCCTTGCCAGCCCGCTCAGGATGATCCAGAGTGTCTTGCAGGCTCTGAG SEQ ID NO:<br>GCCTCCTATGAGCTGACACAGCCACCCTCGGTGTCAGTGTCCCTAGGAC 5978<br>AGATGGCCAGGATCACCTGCTCTGGAGAAGCATTGCCAAAAAAATATGC<br>TTATTGGTACCAGCAGAAGCCAGGCCAGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGATGATCCAGAGTGTCCTGATGGCGCGAGG<br>GAGGC |
| hsIGL_0158_V018_J005_IGLV03-19_IGLJ5_P | GCCTTGCCAGCCCGCTCAGCGCCAATAAGAGTGTCTTGCAGGTTCTGTG SEQ ID NO:<br>GTTTCTTCTGAGCTGACTCAGGACCCTGCTGTGTCTGTGGCCTTGGGAC 5979<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCCGCCAATAAGAGTGTCCTGATGGCGCGAGG<br>GAGGC |
| hsIGL_0159_V019_J005_IGLV03-21_IGLJ5_P | GCCTTGCCAGCCCGCTCAGTCAAGCCTAGAGTGTCTTGCAGGCTCTGTG SEQ ID NO:<br>ACCTCCTATGTGCTGACTCAGCCACCCTCAGTGTCAGTGGCCCCAGGAA 5980<br>AGACGGCCAGGATTACCTGTGGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTCAAGCCTAGAGTGTCCTGATGGCGCGAGG<br>GAGGC |
| hsIGL_0160_V020_J005_IGLV03-22-FP_IGLJ5_P | GCCTTGCCAGCCCGCTCAGACGTGTGTAGAGTGTCCCTCTCTTGCAGGC SEQ ID NO:<br>TCTGTTGCCTCCTATGAGCTGACACAGCTACCCTCGGTGTCAGTGTCCC 5981<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCACGTGTGTAGAGTGTCCTGATGGCGCGAGG<br>GAGGC |
| hsIGL_0161_V021_J005_IGLV03-25_IGLJ5_P | GCCTTGCCAGCCCGCTCAGTCCGTCTAAGAGTGTCTTGCAGGCTCTGAG SEQ ID NO:<br>GCCTCCTATGAGCTGACACAGCCACCCTCGGTGTCAGTGTCCCAGGAC 5982<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTCCGTCTAAGAGTGTCCTGATGGCGCGAGG<br>GAGGC |
| hsIGL_0162_V022_J005_IGLV03-27_IGLJ5_P | GCCTTGCCAGCCCGCTCAGAAGAGCTGAGAGTGTCCTTTTCTTGCAGTC SEQ ID NO:<br>TCTGTGGCCTCCTATGAGCTGACACAGCCATCCTCAGTGTCAGTGTCTC 5983<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCAAGAGCTGAGAGTGTCCTGATGGCGCGAGG<br>GAGGC |

| | | |
|---|---|---|
| hsIGL_0163_V023_J005_IGLV04-03_IGLJ5_P | GCCTTGCCAGCCCGCTCAGTATCGCTCAGAGTGTCTGCTGACTCAGCCC<br>CCGTCTGCATCTGCCTTGCTGGGAGCCTCGATCAAGCTCACCTGCACCC<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC<br>AGCAAGGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG<br>CTCAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTATCGCTCAGAGTGTCCTGATGGCGCGAGG<br>GAGGC | SEQ ID NO:<br>5984 |
| hsIGL_0164_V024_J005_IGLV04-60_IGLJ5_P | GCCTTGCCAGCCCGCTCAGTCAGATGCAGAGTGTCCTCTCTCCCAGCCT<br>GTGCTGACTCAATCATCCTCTGCCTCTGCTTCCCTGGGATCCTCGGTCA<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTCAGATGCAGAGTGTCCTGATGGCGCGAGG<br>GAGGC | SEQ ID NO:<br>5985 |
| hsIGL_0165_V025_J005_IGLV04-69_IGLJ5_P | GCCTTGCCAGCCCGCTCAGGTGTAGCAAGAGTGTCCTCTCTCCCAGCTT<br>GTGCTGACTCAATCGCCCTCTGCCTCTGCCTCCCTGGGAGCCTCGGTCA<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACAGCAAGGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGGCACTGTGAGTGTA<br>GCAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGTGTAGCAAGAGTGTCCTGATGGCGCGAGG<br>GAGGC | SEQ ID NO:<br>5986 |
| hsIGL_0166_V026_J005_IGLV05-37_IGLJ5_P | GCCTTGCCAGCCCGCTCAGTGGCAGTTAGAGTGTCTGTGCTGACTCAGC<br>CACCTTCCTCCTCCGCATCTCCTGGAGAATCCGCCAGACTCACCTGCAC<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT<br>CAGATAAGGGCCAGGGCTCTGGAGTCCCCAGCCGCTTCTCTGGATCCAA<br>AGATGCTTCAGCCAATACAGGGATTTTACTCATCTCCGGGCTCCAGTCT<br>GAGGATGAGGCTGACTATTACTGTATGATTTGGCCAAGCAATGATGGCA<br>GTTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTGGCAGTTAGAGTGTCCTGATGGCGCGAGG<br>GAGGC | SEQ ID NO:<br>5987 |
| hsIGL_0167_V027_J005_IGLV05-39_IGLJ5_P | GCCTTGCCAGCCCGCTCAGCAGTCCAAAGAGTGTCTGTGCTGACTCAGC<br>CAACCTCCCTCTCAGCATCTCCTGGAGCATCAGCCAGATTCACCTGCAC<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCCAGTCCAAAGAGTGTCCTGATGGCGCGAGG<br>GAGGC | SEQ ID NO:<br>5988 |
| hsIGL_0168_V028_J005_IGLV05-45_IGLJ5_P | GCCTTGCCAGCCCGCTCAGTACGTACGAGAGTGTCTGTGCTGACTCAGC<br>CGTCTTCCCTCTCTGCATCTCCTGGAGCATCAGCCAGTCTCACCTGCAC<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTACGTACGAGAGTGTCCTGATGGCGCGAGG<br>GAGGC | SEQ ID NO:<br>5989 |
| hsIGL_0169_V029_J005_IGLV05-52_IGLJ5_P | GCCTTGCCAGCCCGCTCAGAGTACCGAAGAGTGTCTGACTCAGCCATCT<br>TCCCATTCTGCATCTTCTGGAGCATCAGTCAGACTCACCTGCATGCTGA<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT | SEQ ID NO:<br>5990 |

| | INFORMAL SEQUENCE LISTING | |
|---|---|---|
| | AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCAGTACCGAAGAGTGTCCTGATGGCGCGAGG<br>GAGGC | |
| hsIGL_0170_V030_J005_IGLV07-<br>43_IGLJ5_P | GCCTTGCCAGCCCGCTCAGATCCATGGAGAGTGTCAGGGTCCAATTCTC<br>AGACTGTGGTGACTCAGGAGCCCTCACTGACTGTGTCCCCAGGAGGGAC<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTAATCCA<br>TGGAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCATCCATGGAGAGTGTCCTGATGGCGCGAGG<br>GAGGC | SEQ ID NO:<br>5991 |
| hsIGL_0171_V031_J005_IGLV07-<br>46-<br>FP_IGLJ5_P | GCCTTGCCAGCCCGCTCAGGTAGCAGTAGAGTGTCAGGGTCCAATTCCC<br>AGGCTGTGGTGACTCAGGAGCCCTCACTGACTGTGTCCCCAGGAGGGAC<br>AGTCACTCTCACCTGTGGCTCCAGCACTGGAGCTGTCACCAGTGGTCAT<br>TATCCCTACTGGTTCCAGCAGAAGCCTGGCCAAGCCCCCAGGACACTGA<br>TTTATGATACAAGCAACAAACACTCCTGGACACCTGCCCGGTTCTCAGG<br>CTCCCTCCTTGGGGGCAAAGCTGCCCTGACCCTTTTGGGTGCGCAGCCT<br>GAGGATGAGGCTGAGTATTACTGCTTGCTCTCCTATAGTGGTGAGTAGC<br>AGTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCGTAGCAGTAGAGTGTCCTGATGGCGCGAGG<br>GAGGC | SEQ ID NO:<br>5992 |
| hsIGL_0172_V032_J005_IGLV08-<br>61_IGLJ5_P | GCCTTGCCAGCCCGCTCAGATCTTCGTAGAGTGTCGAGTGGATTCTCAG<br>ACTGTGGTGACCCAGGAGCCATCGTTCTCAGTGTCCCCTGGAGGGACAG<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC<br>TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT<br>CGTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCATCTTCGTAGAGTGTCCTGATGGCGCGAGG<br>GAGGC | SEQ ID NO:<br>5993 |
| hsIGL_0173_V033_J005_IGLV09-<br>49_IGLJ5_P | GCCTTGCCAGCCCGCTCAGTCCACAGTAGAGTGTCTGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCTCCACAGTAGAGTGTCCTGATGGCGCGAGG<br>GAGGC | SEQ ID NO:<br>5994 |
| hsIGL_0174_V034_J005_IGLV10-<br>54-<br>FP_IGLJ5_P | GCCTTGCCAGCCCGCTCAGATGACACCAGAGTGTCTGTCAGTGGTCCAG<br>GCAGGGCTGACTCAGCCACCCTCGGTCTCCAAGGGCTTGAGACAGACCG<br>CCCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCATGACACCAGAGTGTCCTGATGGCGCGAGG<br>GAGGC | SEQ ID NO:<br>5995 |
| hsIGL_0175_V035_J005_IGLV11-<br>55-<br>ORF_IGLJ5_P | GCCTTGCCAGCCCGCTCAGCTTCACGAAGAGTGTCCGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCTGGTACCAG<br>CAGAAGCCAGGGAGCTCTCCCAGGTTATTCCTGTATCACTACTCAGACT<br>CAGACAAGCAGCTGGGACCTGGGGTCCCCAGTCGAGTCTCTGGCTCCAA<br>GGAGACCTCAAGTAACACAGCGTTTTTGCTCATCTCTGGGCTCCAGCCT<br>GAGGACGAGGCCGATTATTACTGCCAGGTGTACGAAAGTAGTGACTTCA | SEQ ID NO:<br>5996 |

| INFORMAL SEQUENCE LISTING | |
|---|---|
| | CGAAGAGTGTCGTCGACTGTTTGGTGAGGGGACGGAGCTGACCGTCCTA<br>GATGAGTCTTTTCCCCCTCCTTCCCTGGTCTCCCCAAGGTACTGGGAAA<br>TTTTCTGCTGCTTTTGTTCCTTCACGAAGAGTGTCCTGATGGCGCGAGG<br>GAGGC |
| hsIGL_0176_V001_J006_IGLV01-<br>36_IGLJ6_F | GCCTTGCCAGCCCGCTCAGTAGGAGACGTTCCGAAGGTCCTGGGCCCAG SEQ ID NO:<br>TCTGTGCTGACTCAGCCACCCTCGGTGTCTGAAGCCCCCAGGCAGAGGG 5997<br>TCACCATCTCCTGTTCTGGAAGCAGCTCCAACATCGGAAATAATGCTGT<br>AAAACTGGTACCAGCAGCTCCCAGGAAAGGCTCCCAAACTCCTCATCTAT<br>TATGATGATCTGCTGCCCTCAGGGGTCTCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTAGGAGACGTTCCGAACTGATGGCGCGAGG<br>GAGGC |
| hsIGL_0177_V002_J006_IGLV01-<br>40_IGLJ6_F | GCCTTGCCAGCCCGCTCAGGTGTCTACGTTCCGAACCTGGGCCCAGTCT SEQ ID NO:<br>GTCGTGACGCAGCCGCCCTCAGTGTCTGGGGCCCCAGGGCAGAGGGTCA 5998<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGTGTCTACGTTCCGAACTGATGGCGCGAGG<br>GAGGC |
| hsIGL_0178_V003_J006_IGLV01-<br>44_IGLJ6_F | GCCTTGCCAGCCCGCTCAGGTACAGTGGTTCCGAAGGTCCTGGGCCCAG SEQ ID NO:<br>TCTGTGCTGACTCAGCCACCCTCAGCGTCTGGGACCCCCGGGCAGAGGG 5999<br>TCACCATCTCTTGTTCTGGAAGCAGCTCCAACATCGGAAGTAATACTGT<br>AAAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGTACAGTGGTTCCGAACTGATGGCGCGAGG<br>GAGGC |
| hsIGL_0179_V004_J006_IGLV01-<br>47_IGLJ6_F | GCCTTGCCAGCCCGCTCAGGGATCATCGTTCCGAAGGTCCTGGGCCCAG SEQ ID NO:<br>TCTGTGCTGACTCAGCCACCCTCAGCGTCTGGGACCCCCGGGCAGAGGG 6000<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCGGTCCGAGGA<br>TGAGGCTGATTATTACTGTGCAGCATGGGATGACAGCCTGATGAGGATC<br>ATCGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGGATCATCGTTCCGAACTGATGGCGCGAGG<br>GAGGC |
| hsIGL_0180_V005_J006_IGLV01-<br>50-<br>ORF_IGLJ6_F | GCCTTGCCAGCCCGCTCAGTATTGGCGGTTCCGAACCTGGGCCCAGTCT SEQ ID NO:<br>GTGCTGACGCAGCCGCCCTCAGTGTCTGGGGCCCCAGGGCAGAGGGTCA 6001<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTATTGGCGGTTCCGAACTGATGGCGCGAGG<br>GAGGC |
| hsIGL_0181_V006_J006_IGLV01-<br>51_IGLJ6_F | GCCTTGCCAGCCCGCTCAGAGGCTTGAGTTCCGAAGGTCCTGGGCCCAG SEQ ID NO:<br>TCTGTGTTGACGCAGCCGCCCTCAGTGTCTGCGGCCCAGGACAGAAGG 6002<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTAGGCTTGAGTTCCGAACTGATGGCGCGAGG<br>GAGGC |

| INFORMAL SEQUENCE LISTING | | |
|---|---|---|
| hsIGL_0182_V007_J006_IGLV02-08_IGLJ6_F | GCCTTGCCAGCCCGCTCAGACACACGTGTTCCGAAGTCCTGGGCCCAGT<br>CTGCCCTGACTCAGCCTCCCTCCGCGTCCAGGTCTCCTGGACAGTCAGT<br>CACCATCTCCTGCACTGGAACCAGCAGTGACGTTGGTGGTTATAACTAT<br>GTCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTACACACGTGTTCCGAACTGATGGCGCGAGG<br>GAGGC | SEQ ID NO:<br>6003 |
| hsIGL_0183_V008_J006_IGLV02-11_IGLJ6_F | GCCTTGCCAGCCCGCTCAGTAGACGGAGTTCCGAAATCCTGGGCTCAGT<br>CTGCCCTGACTCAGCCTCGCTCAGTGTCCGGGTCTCCTGGACAGTCAGT<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTAGACGGAGTTCCGAACTGATGGCGCGAGG<br>GAGGC | SEQ ID NO:<br>6004 |
| hsIGL_0184_V009_J006_IGLV02-14_IGLJ6_F | GCCTTGCCAGCCCGCTCAGCAGCTCTTGTTCCGAAGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTCAGCTCTTGTTCCGAACTGATGGCGCGAGG<br>GAGGC | SEQ ID NO:<br>6005 |
| hsIGL_0185_V010_J006_IGLV02-18_IGLJ6_F | GCCTTGCCAGCCCGCTCAGGAGCGATAGTTCCGAAATCCTGGGCTCAGT<br>CTGCCCTGACTCAGCCTCCCTCCGTGTCCGGGTCTCCTGGACAGTCAGT<br>CACCATCTCCTGCACTGGAACCAGCAGTGACGTTGGTAGTTATAACCGT<br>GTCTCCTGGTACCAGCAGCCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGAGCGATAGTTCCGAACTGATGGCGCGAGG<br>GAGGC | SEQ ID NO:<br>6006 |
| hsIGL_0186_V011_J006_IGLV02-23_IGLJ6_F | GCCTTGCCAGCCCGCTCAGGCATCTGAGTTCCGAAGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGCATCTGAGTTCCGAACTGATGGCGCGAGG<br>GAGGC | SEQ ID NO:<br>6007 |
| hsIGL_0187_V012_J006_IGLV02-33-ORF_IGLJ6_F | GCCTTGCCAGCCCGCTCAGTGCTACACGTTCCGAAGTCCTGGGCCCAGT<br>CTGCCCTGACTCAGCCTCCTTTTGTGTCCGGGGCTCCTGGACAGTCGGT<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTGCTACACGTTCCGAACTGATGGCGCGAGG<br>GAGGC | SEQ ID NO:<br>6008 |
| hsIGL_0188_V013_J006_IGLV03-01_IGLJ6_F | GCCTTGCCAGCCCGCTCAGAACTGCCAGTTCCGAACTCTCCTGTAGGAT<br>CCGTGGCCTCCTATGAGCTGACTCAGCCACCCTCAGTGTCCGTGTCCCC<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG | SEQ ID NO:<br>6009 |

| INFORMAL SEQUENCE LISTING | |
|---|---|
| | CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTAACTGCCAGTTCCGAACTGATGGCGCGAGG<br>GAGGC |
| hsIGL_0189_V014_J006_IGLV03-<br>09-<br>FP_IGLJ6_F | GCCTTGCCAGCCCGCTCAGTTGGACTGGTTCCGAATTTTCTTGCAGGTT SEQ ID NO:<br>CTGTGGCCTCCTATGAGCTGACTCAGCCACTCTCAGTGTCAGTGGCCCT 6010<br>GGGACAGGCGGCCAGGATTACCTGTGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTTGGACTGGTTCCGAACTGATGGCGCGAGG<br>GAGGC |
| hsIGL_0190_V015_J006_IGLV03-<br>10_IGLJ6_F | GCCTTGCCAGCCCGCTCAGGTAGACACGTTCCGAATTGCAGTCTCTGAG SEQ ID NO:<br>GCCTCCTATGAGCTGACACAGCCACCCTCGGTGTCAGTGTCCCCAGGAC 6011<br>AAACGGCCAGGATCACCTGCTCTGGAGATGCATTGCCAAAAAATATGC<br>TTATTGGTACCAGCAGAAGTCAGGCCAGGCCCCTGTGCTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACAGCAGTGGTATGAGTAGA<br>CACGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGTAGACACGTTCCGAACTGATGGCGCGAGG<br>GAGGC |
| hsIGL_0191_V016_J006_IGLV03-<br>12_IGLJ6_F | GCCTTGCCAGCCCGCTCAGCACTGTACGTTCCGAATTGCAGGCTCTGCG SEQ ID NO:<br>ACCTCCTATGAGCTGACTCAGCCACACTCAGTGTCAGTGGCCACAGCAC 6012<br>AGATGGCCAGGATCACCTGTGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG<br>TACGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTCACTGTACGTTCCGAACTGATGGCGCGAGG<br>GAGGC |
| hsIGL_0192_V017_J006_IGLV03-<br>16_IGLJ6_F | GCCTTGCCAGCCCGCTCAGGATGATCCGTTCCGAATTGCAGGCTCTGAG SEQ ID NO:<br>GCCTCCTATGAGCTGACACAGCCACCCTCGGTGTCAGTGTCCCTAGGAC 6013<br>AGATGGCCAGGATCACCTGCTCTGGAGAAGCATTGCCAAAAAATATGC<br>TTATTGGTACCAGCAGAAGCCAGGCCAGGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGATGATCCGTTCCGAACTGATGGCGCGAGG<br>GAGGC |
| hsIGL_0193_V018_J006_IGLV03-<br>19_IGLJ6_F | GCCTTGCCAGCCCGCTCAGCGCCAATAGTTCCGAATTGCAGGTTCTGTG SEQ ID NO:<br>GTTTCTTCTGAGCTGACTCAGGACCCTGCTGTGTCTGTGGCCTTGGGAC 6014<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCGGGACAGCAGTGGTATGACGCCA<br>ATAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGCCAATAGTTCCGAACTGATGGCGCGAGG<br>GAGGC |
| hsIGL_0194_V019_J006_IGLV03-<br>21_IGLJ6_F | GCCTTGCCAGCCCGCTCAGTCAAGCCTGTTCCGAATTGCAGGCTCTGTG SEQ ID NO:<br>ACCTCCTATGTGCTGACTCAGCCACCCTCAGTGTCAGTGGCCCAGGAA 6015<br>AGACGGCCAGGATTACCTGTGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGA<br>TGAGGCCGACTATTACTGTCAGGTGTGGGACAGTAGTAGTGTGATCAAG<br>CCTGTTCCGAAGTCGACTGTTCGGCAGTGGCACCAAGGTGACCGTCCTC |

| INFORMAL SEQUENCE LISTING | |
|---|---|
| | GGTGAGTCCCCTTTTCTATTCTTTTGGGTCTAGGGTGAGATCTGGGGAG<br>ACTTTTCTGTCCTTTCTGTTCAAGCCTGTTCCGAACTGATGGCGCGAGG<br>GAGGC |
| hsIGL_0195_V020_J006_IGLV03-<br>22-<br>FP_IGLJ6_F | GCCTTGCCAGCCCGCTCAGACGTGTGTGTTCCGAACCTCTCTTGCAGGC SEQ ID NO:<br>TCTGTTGCCTCCTATGAGCTGACACAGCTACCCTCGGTGTCAGTGTCCC 6016<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTACGTGTGTGTTCCGAACTGATGGCGCGAGG<br>GAGGC |
| hsIGL_0196_V021_J006_IGLV03-<br>25_IGLJ6_F | GCCTTGCCAGCCCGCTCAGTCCGTCTAGTTCCGAATTGCAGGCTCTGAG SEQ ID NO:<br>GCCTCCTATGAGCTGACACAGCCACCCTCGGTGTCAGTGTCCCCAGGAC 6017<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTCCGTCTAGTTCCGAACTGATGGCGCGAGG<br>GAGGC |
| hsIGL_0197_V022_J006_IGLV03-<br>27_IGLJ6_F | GCCTTGCCAGCCCGCTCAGAAGAGCTGGTTCCGAACTTTTCTTGCAGTC SEQ ID NO:<br>TCTGTGGCCTCCTATGAGCTGACACAGCCATCCTCAGTGTCAGTGTCTC 6018<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTAAGAGCTGGTTCCGAACTGATGGCGCGAGG<br>GAGGC |
| hsIGL_0198_V023_J006_IGLV04-<br>03_IGLJ6_F | GCCTTGCCAGCCCGCTCAGTATCGCTCGTTCCGAATGCTGACTCAGCCC SEQ ID NO:<br>CCGTCTGCATCTGCCTTGCTGGGAGCCTCGATCAAGCTCACCTGCACCC 6019<br>TAAGCAGTGAGCACAGCACCTACACCATCGAATGGTATCAACAGAGACC<br>AGGGAGGTCCCCCCAGTATATAATGAAGGTTAAGAGTGATGGCAGCCAC<br>AGCAAGGGGGACGGGATCCCCGATCGCTTCATGGGCTCCAGTTCTGGGG<br>CTGACCGCTACCTCACCTTCTCCAACCTCCAGTCTGACGATGAGGCTGA<br>GTATCACTGTGGAGAGAGCCACACGATTGATGGCCAAGTCGTGATATCG<br>CTCGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTATCGCTCGTTCCGAACTGATGGCGCGAGG<br>GAGGC |
| hsIGL_0199_V024_J006_IGLV04-<br>60_IGLJ6_F | GCCTTGCCAGCCCGCTCAGTCAGATGCGTTCCGAACTCTCTCCCAGCCT SEQ ID NO:<br>GTGCTGACTCAATCATCCTCTGCCTCTGCTTCCCTGGGATCCTCGGTCA 6020<br>AGCTCACCTGCACTCTGAGCAGTGGGCACAGTAGCTACATCATCGCATG<br>GCATCAGCAGCAGCCAGGGAAGGCCCCTCGGTACTTGATGAAGCTTGAA<br>GGTAGTGGAAGCTACAACAAGGGGAGCGGAGTTCCTGATCGCTTCTCAG<br>GCTCCAGCTCTGGGGCTGACCGCTACCTCACCATCTCCAACCTCCAGTT<br>TGAGGATGAGGCTGATTATTACTGTGAGACCTGGGACAGTATGATCAGA<br>TGCGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTCAGATGCGTTCCGAACTGATGGCGCGAGG<br>GAGGC |
| hsIGL_0200_V025_J006_IGLV04-<br>69_IGLJ6_F | GCCTTGCCAGCCCGCTCAGGTGTAGCAGTTCCGAACTCTCTCCCAGCTT SEQ ID NO:<br>GTGCTGACTCAATCGCCCTCTGCCTCTGCCTCCCTGGGAGCCTCGGTCA 6021<br>AGCTCACCTGCACTCTGAGCAGTGGGCACAGCAGCTACGCCATCGCATG<br>GCATCAGCAGCAGCCAGAGAAGGGCCCTCGGTACTTGATGAAGCTTAAC<br>AGTGATGGCAGCCACAGCAAGGGGGACGGGATCCCTGATCGCTTCTCAG<br>GCTCCAGCTCTGGGGCTGAGCGCTACCTCACCATCTCCAGCCTCCAGTC<br>TGAGGATGAGGCTGACTATTACTGTCAGACCTGGGCACTGTGAGTGTA<br>GCAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGTGTAGCAGTTCCGAACTGATGGCGCGAGG<br>GAGGC |

INFORMAL SEQUENCE LISTING

| | | |
|---|---|---|
| hsIGL_0201_V026_J006_IGLV05-37_IGLJ6_F | GCCTTGCCAGCCCGCTCAGTGGCAGTTGTTCCGAATGTGCTGACTCAGC<br>CACCTTCCTCCTCCGCATCTCCTGGAGAATCCGCCAGACTCACCTGCAC<br>CTTGCCCAGTGACATCAATGTTGGTAGCTACAACATATACTGGTACCAG<br>CAGAAGCCAGGGAGCCCTCCCAGGTATCTCCTGTACTACTACTCAGACT<br>CAGATAAGGGCCAGGGCTCTGGAGTCCCCAGCCGCTTCTCTGGATCCAA<br>AGATGCTTCAGCCAATACAGGGATTTTACTCATCTCCGGGCTCCAGTCT<br>GAGGATGAGGCTGACTATTACTGTATGATTTGGCCAAGCAATGATGGCA<br>GTTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTGGCAGTTGTTCCGAACTGATGGCGCGAGG<br>GAGGC | SEQ ID NO:<br>6022 |
| hsIGL_0202_V027_J006_IGLV05-39_IGLJ6_F | GCCTTGCCAGCCCGCTCAGCAGTCCAAGTTCCGAATGTGCTGACTCAGC<br>CAACCTCCCTCTCAGCATCTCCTGGAGCATCAGCCAGATTCACCTGCAC<br>CTTGCGCAGCGGCATCAATGTTGGTACCTACAGGATATACTGGTACCAG<br>CAGAATCCAGGGAGTCTTCCCCGGTATCTCCTGAGGTACAAATCAGACT<br>CAGATAAGCAGCAGGGCTCTGGAGTCCCCAGCCGCTTCTCTGGATCCAA<br>AGATGCTTCAACCAATGCAGGCCTTTTACTCATCTCTGGGCTCCAGTCT<br>GAAGATGAGGCTGACTATTACTGTGCCATTTGGTACAGCAGTGACAGTC<br>CAAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTCAGTCCAAGTTCCGAACTGATGGCGCGAGG<br>GAGGC | SEQ ID NO:<br>6023 |
| hsIGL_0203_V028_J006_IGLV05-45_IGLJ6_F | GCCTTGCCAGCCCGCTCAGTACGTACGGTTCCGAATGTGCTGACTCAGC<br>CGTCTTCCCTCTCTGCATCTCCTGGAGCATCAGCCAGTCTCACCTGCAC<br>CTTGCGCAGTGGCATCAATGTTGGTACCTACAGGATATACTGGTACCAG<br>CAGAAGCCAGGGAGTCCTCCCCAGTATCTCCTGAGGTACAAATCAGACT<br>CAGATAAGCAGCAGGGCTCTGGAGTCCCCAGCCGCTTCTCTGGATCCAA<br>AGATGCTTCGGCCAATGCAGGGATTTTACTCATCTCTGGGCTCCAGTCT<br>GAGGATGAGGCTGACTATTACTGTATGATTTGGCACAGCAGTGATACGT<br>ACGGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTACGTACGGTTCCGAACTGATGGCGCGAGG<br>GAGGC | SEQ ID NO:<br>6024 |
| hsIGL_0204_V029_J006_IGLV05-52_IGLJ6_F | GCCTTGCCAGCCCGCTCAGAGTACCGAGTTCCGAATGACTCAGCCATCT<br>TCCCATTCTGCATCTTCTGGAGCATCAGTCAGACTCACCTGCATGCTGA<br>GCAGTGGCTTCAGTGTTGGGGACTTCTGGATAAGGTGGTACCAACAAAA<br>GCCAGGGAACCCTCCCCGGTATCTCCTGTACTACCACTCAGACTCCAAT<br>AAGGGCCAAGGCTCTGGAGTTCCCAGCCGCTTCTCTGGATCCAACGATG<br>CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTAGTACCGAGTTCCGAACTGATGGCGCGAGG<br>GAGGC | SEQ ID NO:<br>6025 |
| hsIGL_0205_V030_J006_IGLV07-43_IGLJ6_F | GCCTTGCCAGCCCGCTCAGATCCATGGGTTCCGAAAGGGTCCAATTCTC<br>AGACTGTGGTGACTCAGGAGCCCTCACTGACTGTGTCCCAGGAGGGAC<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTGAATCCA<br>TGGGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTATCCATGGGTTCCGAACTGATGGCGCGAGG<br>GAGGC | SEQ ID NO:<br>6026 |
| hsIGL_0206_V031_J006_IGLV07-46-FP_IGLJ6_F | GCCTTGCCAGCCCGCTCAGGTAGCAGTGTTCCGAAAGGGTCCAATTCCC<br>AGGCTGTGGTGACTCAGGAGCCCTCACTGACTGTGTCCCAGGAGGGAC<br>AGTCACTCTCACCTGTGGCTCCAGCACTGGAGCTGTCACCAGTGGTCAT<br>TATCCCTACTGGTTCCAGCAGAAGCCTGGCCAAGCCCCCAGGACACTGA<br>TTTATGATACAAGCAACAAACACTCCTGGACACCTGCCCGGTTCTCAGG<br>CTCCCTCCTTGGGGGCAAAGCTGCCCTGACCCTTTGGGTGCGCAGCCT<br>GAGGATGAGGCTGAGTATTACTGCTTGCTCTCCTATAGTGGTGAGTAGC<br>AGTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTGTAGCAGTGTTCCGAACTGATGGCGCGAGG<br>GAGGC | SEQ ID NO:<br>6027 |
| hsIGL_0207_V032_J006_IGLV08-61_IGLJ6_F | GCCTTGCCAGCCCGCTCAGATCTTCGTGTTCCGAAGAGTGGATTCTCAG<br>ACTGTGGTGACCCAGGAGCCATCGTTCTCAGTGTCCCCTGGAGGGACA<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC | SEQ ID NO:<br>6028 |

| | | |
|---|---|---|
| | TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT<br>CGTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTATCTTCGTGTTCCGAACTGATGGCGCGAGG<br>GAGGC | |
| hsIGL_0208_V033_J006_IGLV09-<br>49_IGLJ6_F | GCCTTGCCAGCCCGCTCAGTCCACAGTGTTCCGAATGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTTCCACAGTGTTCCGAACTGATGGCGCGAGG<br>GAGGC | SEQ ID NO:<br>6029 |
| hsIGL_0209_V034_J006_IGLV10-<br>54-<br>FP_IGLJ6_F | GCCTTGCCAGCCCGCTCAGATGACACCGTTCCGAATGTCAGTGGTCCAG<br>GCAGGGCTGACTCAGCCACCCTCGGTCTCCAAGGGCTTGAGACAGACCG<br>CCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTATGACACCGTTCCGAACTGATGGCGCGAGG<br>GAGGC | SEQ ID NO:<br>6030 |
| hsIGL_0210_V035_J006_IGLV11-<br>55-<br>ORF_IGLJ6_F | GCCTTGCCAGCCCGCTCAGCTTCACGAGTTCCGAACGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCGGTACCAG<br>CAGAAGCCAGGGAGCTCTCCCAGGTTATTCCTGTATCACTACTCAGACT<br>CAGACAAGCAGCTGGGACCTGGGGTCCCCAGTCGAGTCTCTGGCTCCAA<br>GGAGACCTCAAGTAACACAGCGTTTTTGCTCATCTCTGGGCTCCAGCCT<br>GAGGACGAGGCCGATTATTACTGCCAGGTGTACGAAAGTAGTGACTTCA<br>CGAGTTCCGAAGTCGACTGTTCGGCAGTGGCACCAAGGTGACCGTCCTC<br>GGTGAGTCCCCTTTTCTATTCTTTTGGGTCTAGGGTGAGATCTGGGGAG<br>ACTTTTCTGTCCTTTCTGTCTTCACGAGTTCCGAACTGATGGCGCGAGG<br>GAGGC | SEQ ID NO:<br>6031 |
| hsIGL_0211_V001_J007_IGLV01-<br>36_IGLJ7_F | GCCTTGCCAGCCCGCTCAGTAGGAGACCGTTACTTGGTCCTGGGCCCAG<br>TCTGTGCTGACTCAGCCACCCTCGGTGTCTGAAGCCCCCAGGCAGAGGG<br>TCACCATCTCCTGTTCTGGAAGCAGCTCCAACATCGGAAATAATGCTGT<br>AAACTGGTACCAGCAGCTCCCAGGAAAGGCTCCCAAACTCCTCATCTAT<br>TATGATGATCTGCTGCCCTCAGGGGTCTCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGATAGGA<br>GACCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTAGGAGACCGTTACTTCTGATGGCGCGAGG<br>GAGGC | SEQ ID NO:<br>6032 |
| hsIGL_0212_V002_J007_IGLV01-<br>40_IGLJ7_F | GCCTTGCCAGCCCGCTCAGGTGTCTACCGTTACTTCCTGGGCCCAGTCT<br>GTCGTGACGCAGCCGCCCTCAGTGTCTGGGGCCCCAGGGCAGAGGGTCA<br>CCATCTCCTGCACTGGGAGCAGCTCCAACATCGGGGCAGGTTATGATGT<br>ACACTGGTACCAGCAGCTTCCAGGAACAGCCCCCAAACTCCTCATCTAT<br>GGTAACAGCAATCGGCCCTCAGGGGTCCCTGACCGATTCTCTGGCTCCA<br>AGTCTGGCACCTCAGCCTCCCTGGCCATCACTGGGCTCCAGGCTGAGGA<br>TGAGGCTGATTATTACTGCCAGTCCTATGACAGCAGCCTGATGAGTGTC<br>TACCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGTGTCTACCGTTACTTCTGATGGCGCGAGG<br>GAGGC | SEQ ID NO:<br>6033 |
| hsIGL_0213_V003_J007_IGLV01-<br>44_IGLJ7_F | GCCTTGCCAGCCCGCTCAGGTACAGTGCGTTACTTGGTCCTGGGCCCAG<br>TCTGTGCTGACTCAGCCACCCTCAGCGTCTGGGACCCCCGGGCAGAGGG<br>TCACCATCTCTTGTTCTGGAAGCAGCTCCAACATCGGAAGTAATACTGT<br>AAACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCAGTCTGAGGA<br>TGAGGCTGATTATTACTGTGCAGCATGGGATGACAGCCTGATGAGTACA<br>GTGCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG | SEQ ID NO:<br>6034 |

| INFORMAL SEQUENCE LISTING | |
|---|---|
| | GGAGTTTTTCCCTTTCCTGGTACAGTGCGTTACTTCTGATGGCGCGAGG<br>GAGGC |
| hsIGL_0214_V004_J007_IGLV01-<br>47_TGLJ7_F | GCCTTGCCAGCCCGCTCAGGGATCATCCGTTACTTGGTCCTGGGCCCAG SEQ ID NO:<br>TCTGTGCTGACTCAGCCACCCTCAGCGTCTGGGACCCCCGGGCAGAGGG 6035<br>TCACCATCTCTTGTTCTGGAAGCAGCTCCAACATCGGAAGTAATTATGT<br>ATACTGGTACCAGCAGCTCCCAGGAACGGCCCCCAAACTCCTCATCTAT<br>AGTAATAATCAGCGGCCCTCAGGGGTCCCTGACCGATTCTCTGGCTCCA<br>AGTCTGGCACCTCAGCCTCCCTGGCCATCAGTGGGCTCCGGTCCGAGGA<br>TGAGGCTGATTATTACTGTGCAGCATGGGATGACAGCCTGATGAGGATC<br>ATCCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGGATCATCCGTTACTTCTGATGGCGCGAGG<br>GAGGC |
| hsIGL_0215_V005_J007_IGLV01-<br>50-<br>ORF_IGLJ7_F | GCCTTGCCAGCCCGCTCAGTATTGGCGCGTTACTTCCTGGGCCCAGTCT SEQ ID NO:<br>GTGCTGACGCAGCCGCCCTCAGTGTCTGGGGCCCCAGGGCAGAGGGTCA 6036<br>CCATCTCCTGCACTGGGAGCAGCTCCAACATTGGGGCGGGTTATGTTGT<br>ACATTGGTACCAGCAGCTTCCAGGAACAGCCCCCAAACTCCTCATCTAT<br>GGTAACAGCAATCGGCCCTCAGGGGTCCCTGACCAATTCTCTGGCTCCA<br>AGTCTGGCACCTCAGCCTCCCTGGCCATCACTGGACTCCAGTCTGAGGA<br>TGAGGCTGATTATTACTGCAAAGCATGGGATAACAGCCTGATGATATTG<br>GCGCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTATTGGCGCGTTACTTCTGATGGCGCGAGG<br>GAGGC |
| hsIGL_0216_V006_J007_IGLV01-<br>51_IGLJ7_F | GCCTTGCCAGCCCGCTCAGAGGCTTGACGTTACTTGGTCCTGGGCCCAG SEQ ID NO:<br>TCTGTGTTGACGCAGCCGCCCTCAGTGTCTGCGGCCCCAGGACAGAAGG 6037<br>TCACCATCTCCTGCTCTGGAAGCAGCTCCAACATTGGGAATAATTATGT<br>ATCCTGGTACCAGCAGCTCCCAGGAACAGCCCCCAAACTCCTCATTTAT<br>GACAATAATAAGCGACCCTCAGGGATTCCTGACCGATTCTCTGGCTCCA<br>AGTCTGGCACGTCAGCCACCCTGGGCATCACCGGACTCCAGACTGGGGA<br>CGAGGCCGATTATTACTGCGGAACATGGGATAGCAGCCTGATGAAGGCT<br>TGACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGAGGCTTGACGTTACTTCTGATGGCGCGAGG<br>GAGGC |
| hsIGL_0217_V007_J007_IGLV02-<br>08_IGLJ7_F | GCCTTGCCAGCCCGCTCAGACACACGTCGTTACTTGTCCTGGGCCCAGT SEQ ID NO:<br>CTGCCCTGACTCAGCCTCCCTCCGCGTCCAGGTCTCCTGGACAGTCAGT 6038<br>CACCATCTCCTGCACTGGAACCAGCAGTGACGTTGGTGGTTATAACTAT<br>GTCTCCTGGTACCAACAGCACCCAGGCAAAGCCCCCAAACTCATGATTT<br>ATGAGGTCAGTAAGCGGCCCTCAGGGGTCCCTGATCGCTTCTCTGGCTC<br>CAAGTCTGGCAACACGGCCTCCCTGACCGTCTCTGGGCTCCAGGCTGAG<br>GATGAGGCTGATTATTACTGCAGCTCATATGCAGGCAGCAATGAACACA<br>CGTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGACACACGTCGTTACTTCTGATGGCGCGAGG<br>GAGGC |
| hsIGL_0218_V008_J007_IGLV02-<br>11_IGLJ7_F | GCCTTGCCAGCCCGCTCAGTAGACGGACGTTACTTATCCTGGGCTCAGT SEQ ID NO:<br>CTGCCCTGACTCAGCCTCGCTCAGTGTCCGGGTCTCCTGGACAGTCGGT 6039<br>CACCATCTCCTGCACTGGAACCAGCAGTGATGTTGGTGGTTATAACTAT<br>GTCTCCTGGTACCAACAGCACCCAGGCAAAGCCCCCAAACTCATGATTT<br>ATGATGTCAGTAAGCGGCCCTCAGGGGTCCCTGATCGCTTCTCTGGCTC<br>CAAGTCTGGCAACACGGCCTCCCTGACCATCTCTGGGCTCCAGGCTGAG<br>GATGAGGCTGATTATTACTGCTGCTCATATGCAGGCAGCTATGATAGAC<br>GGACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTAGACGGACGTTACTTCTGATGGCGCGAGG<br>GAGGC |
| hsIGL_0219_V009_J007_IGLV02-<br>14_IGLJ7_F | GCCTTGCCAGCCCGCTCAGCAGCTCTTCGTTACTTGTCCTGGGCCCAGT SEQ ID NO:<br>CTGCCCTGACTCAGCCTGCCTCCGTGTCTGGGTCTCCTGGACAGTCGAT 6040<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACCATCTCTGGGCTCCAGGCTGAG<br>GACGAGGCTGATTATTACTGCAGCTCATATACAAGCAGCAGTGACAGCT<br>CTTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGCAGCTCTTCGTTACTTCTGATGGCGCGAGG<br>GAGGC |
| hsIGL_0220_V010_J007_IGLV02-<br>18_IGLJ7_F | GCCTTGCCAGCCCGCTCAGGAGCGATACGTTACTTATCCTGGGCTCAGT SEQ ID NO:<br>CTGCCCTGACTCAGCCTCCCTCCGTGTCCGGGTCTCCTGGACAGTCAGT 6041 |

INFORMAL SEQUENCE LISTING

| | | |
|---|---|---|
| | CACCATCTCCTGCACTGGAACCAGCAGTGACGTTGGTAGTTATAACCGT<br>GTCTCCTGGTACCAGCAGCCCCCAGGCACAGCCCCCAAACTCATGATTT<br>ATGAGGTCAGTAATCGGCCCTCAGGGGTCCCTGATCGCTTCTCTGGGTC<br>CAAGTCTGGCAACACGGCCTCCCTGACCACCTCTGGGCTCCAGGCTGAG<br>GACGAGGCTGATTATTACTGCAGCTCATATACAAGCAGCAGTGAGAGCG<br>ATACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGAGCGATACGTTACTTCTGATGGCGCGAGG<br>GAGGC | |
| hsIGL_0221_V011_J007_IGLV02-<br>23_IGLJ7_F | GCCTTGCCAGCCCGCTCAGGCATCTGACGTTACTTGTCCTGGGCCCAGT<br>CTGCCCTGACTCAGCCTGCCTCCGTGTCTGGGTCTCCTGGACAGTCGAT<br>CACCATCTCCTGCACTGGAACCAGCAGTGATGTTGGGAGTTATAACCTT<br>GTCTCCTGGTACCAACAGCACCCAGGCAAAGCCCCCAAACTCATGATTT<br>ATGAGGGCAGTAAGCGGCCCTCAGGGGTTTCTAATCGCTTCTCTGGCTC<br>CAAGTCTGGCAACACGGCCTCCCTGACAATCTCTGGGCTCCAGGCTGAG<br>GACGAGGCTGATTATTACTGCTGCTCATATGCAGGTAGTAGTGAGCATC<br>TGACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGCATCTGACGTTACTTCTGATGGCGCGAGG<br>GAGGC | SEQ ID NO:<br>6042 |
| hsIGL_0222_V012_J007_IGLV02-<br>33-<br>ORF_IGLJ7_F | GCCTTGCCAGCCCGCTCAGTGCTACACCGTTACTTGTCCTGGGCCCAGT<br>CTGCCCTGACTCAGCCTCCTTTTGTGTCCGGGACTCCTGGACAGTCGGT<br>CACCATCTCCTGCACTGGAACCAGCAGTGACGTTGGGGATTATGATCAT<br>GTCTTCTGGTACCAAAAGCGTCTCAGCACTACCTCCAGACTCCTGATTT<br>ACAATGTCAATACTCGGCCTTCAGGGATCTCTGACCTCTTCTCAGGCTC<br>CAAGTCTGGCAACATGGCTTCCCTGACCATCTCTGGGCTCAAGTCCGAG<br>GTTGAGGCTAATTATCACTGCAGCTTATATTCAAGTAGTTATGATGCTA<br>CACCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTGCTACACCGTTACTTCTGATGGCGCGAGG<br>GAGGC | SEQ ID NO:<br>6043 |
| hsIGL_0223_V013_J007_IGLV03-<br>01_IGLJ7_F | GCCTTGCCAGCCCGCTCAGAACTGCCACGTTACTTCTCTCCTGTAGGAT<br>CCGTGGCCTCCTATGAGCTGACTCAGCCACCCTCAGTGTCCGTGTCCCC<br>AGGACAGACAGCCAGCATCACCTGCTCTGGAGATAAATTGGGGGATAAA<br>TATGCTTGCTGGTATCAGCAGAAGCCAGGCCAGTCCCCTGTGCTGGTCA<br>TCTATCAAGATAGCAAGCGGCCCTCAGGGATCCCTGAGCGATTCTCTGG<br>CTCCAACTCTGGGAACACAGCCACTCTGACCATCAGCGGGACCCAGGCT<br>ATGGATGAGGCTGACTATTACTGTCAGGCGTGGGACAGCAGTGAAACTG<br>CCACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGAACTGCCACGTTACTTCTGATGGCGCGAGG<br>GAGGC | SEQ ID NO:<br>6044 |
| hsIGL_0224_V014_J007_IGLV03-<br>09-<br>FP_IGLJ7_F | GCCTTGCCAGCCCGCTCAGTTGGACTGCGTTACTTTTTCTTGCAGGTT<br>CTGTGGCCTCCTATGAGCTGACTCAGCCACTCTCAGTGTCAGTGGCCCT<br>GGGACAGGCGGCCAGGATTACCTGTGGGGGAAACAACCTTGGATATAAA<br>AATGTGCACTGGTACCAGCAGAAGCCAGGCCAGGCCCCTGTGCTGGTCA<br>TCTATAGGGATAACAACCGGCCCTCTGGGATCCCTGAGCGATTCTCTGG<br>CTCCAACTCGGGGAACACGGCCACCCTGACCATCAGCAGAGCCCAAGCC<br>GGGGATGAGGCTGACTATTACTGTCAGGTGTGGGACAGCAGTGATTGGA<br>CTGCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTTGGACTGCGTTACTTCTGATGGCGCGAGG<br>GAGGC | SEQ ID NO:<br>6045 |
| hsIGL_0225_V015_J007_IGLV03-<br>10_IGLJ7_F | GCCTTGCCAGCCCGCTCAGGTAGACACCGTTACTTTTGCAGTCTCTGAG<br>GCCTCCTATGAGCTGACACAGCCACCCTCGGTGTCAGTGTCCCCAGGAC<br>AAACGGCCAGGATCACCTGCTCTGGAGATGCATTGCCAAAAAAATATGC<br>TTATTGGTACCAGCAGAAGTCAGGCCAGGCCCCTGTGGTCATCTAT<br>GAGGACAGCAAACGACCCTCCGGGATCCCTGAGAGATTCTCTGGCTCCA<br>GCTCAGGGACAATGGCCACCTTGACTATCAGTGGGGCCCAGGTGGAGGA<br>TGAAGCTGACTACTACTGTTACTCAACAGACAGCAGTGGTATGAGTAGA<br>CACCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGTAGACACCGTTACTTCTGATGGCGCGAGG<br>GAGGC | SEQ ID NO:<br>6046 |
| hsIGL_0226_V016_J007_IGLV03-<br>12_IGLJ7_F | GCCTTGCCAGCCCGCTCAGCACTGTACCGTTACTTTTGCAGGCTCTGCG<br>ACCTCCTATGAGCTGACTCAGCCACACTCAGTGTCAGTGGCCACAGCAC<br>AGATGGCCAGGATCACCTGTGGGGGAAACAACATTGGAAGTAAAGCTGT<br>GCACTGGTACCAGCAAAAGCCAGGCCAGGACCCTGTGCTGGTCATCTAT<br>AGCGATAGCAACCGGCCCTCAGGGATCCCTGAGCGATTCTCTGGCTCCA<br>ACCCAGGGAACACCGCCACCCTAACCATCAGCAGGATCGAGGCTGGGGA<br>TGAGGCTGACTATTACTGTCAGGTGTGGGACAGTAGTAGTGTGACACTG | SEQ ID NO:<br>6047 |

| | INFORMAL SEQUENCE LISTING |
|---|---|
| | TACCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGCACTGTACCGTTACTTCTGATGGCGCGAGG<br>GAGGC |
| hsIGL_0227_V017_J007_IGLV03-16_IGLJ7_F | GCCTTGCCAGCCCGCTCAGGATGATCCCGTTACTTTTGCAGGCTCTGAG SEQ ID NO:<br>GCCTCCTATGAGCTGACACAGCCACCCTCGGTGTCAGTGTCCCTAGGAC 6048<br>AGATGGCCAGGATCACCTGCTCTGGAGAAGCATTGCCAAAAAAATATGC<br>TTATTGGTACCAGCAGAAGCCAGGCCAGTTCCCTGTGCTGGTGATATAT<br>AAAGACAGCGAGAGGCCCTCAGGGATCCCTGAGCGATTCTCTGGCTCCA<br>GCTCAGGGACAATAGTCACATTGACCATCAGTGGAGTCCAGGCAGAAGA<br>CGAGGCTGACTATTACTGTCTATCAGCAGACAGCAGTGGTATGAGATGA<br>TCCCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGATGATCCCGTTACTTCTGATGGCGCGAGG<br>GAGGC |
| hsIGL_0228_V018_J007_IGLV03-19_IGLJ7_F | GCCTTGCCAGCCCGCTCAGCGCCAATACGTTACTTTTGCAGGTTCTGTG SEQ ID NO:<br>GTTTCTTCTGAGCTGACTCAGGACCCTGCTGTGTCTGTGGCCTTGGGAC 6049<br>AGACAGTCAGGATCACATGCCAAGGAGACAGCCTCAGAAGCTATTATGC<br>AAGCTGGTACCAGCAGAAGCCAGGACAGGCCCCTGTACTTGTCATCTAT<br>GGTAAAAACAACCGGCCCTCAGGGATCCCAGACCGATTCTCTGGCTCCA<br>GCTCAGGAAACACAGCTTCCTTGACCATCACTGGGGCTCAGGCGGAAGA<br>TGAGGCTGACTATTACTGTAACTCCCGGGACAGCAGTGGTATGACGCCA<br>ATACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGCGCCAATACGTTACTTCTGATGGCGCGAGG<br>GAGGC |
| hsIGL_0229_V019_J007_IGLV03-21_IGLJ7_F | GCCTTGCCAGCCCGCTCAGTCAAGCCTCGTTACTTTTGCAGGCTCTGTG SEQ ID NO:<br>ACCTCCTATGTGCTGACTCAGCCACCCTCAGTGTCAGTGGCCCCAGGAA 6050<br>AGACGGCCAGGATTACCTGTGGGGGAAACAACATTGGAAGTAAAAGTGT<br>GCACTGGTACCAGCAGAAGCCAGGCCAGGCCCCTGTGCTGGTCATCTAT<br>TATGATAGCGACCGGCCCTCAGGGATCCCTGAGCGATTCTCTGGCTCCA<br>ACTCTGGGAACACGGCCACCCTGACCATCAGCAGGGTCGAAGCCGGGGA<br>TGAGGCCGACTATTACTGTCAGGTGTGGGACAGTAGTAGTGTGATCAAG<br>CCTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTCAAGCCTCGTTACTTCTGATGGCGCGAGG<br>GAGGC |
| hsIGL_0230_V020_J007_IGLV03-22-FP_IGLJ7_F | GCCTTGCCAGCCCGCTCAGACGTGTGTCGTTACTTCCTCTCTTGCAGGC SEQ ID NO:<br>TCTGTTGCCTCCTATGAGCTGACACAGCTACCCTCGGTGTCAGTGTCCC 6051<br>CAGGACAGAAAGCCAGGATCACCTGCTCTGGAGATGTACTGGGGAAAAA<br>TTATGCTGACTGGTACCAGCAGAAGCCAGGCCAGGCCCCTGAGTTGGTG<br>ATATACGAAGATAGTGAGCGGTACCCTGGAATCCCTGAACGATTCTCTG<br>GGTCCACCTCAGGGAACACGACCACCCTGACCATCAGCAGGGTCCTGAC<br>CGAAGACGAGGCTGACTATTACTGTTTGTCTGGGAATGAGGTGAACGTG<br>TGTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGACGTGTGTCGTTACTTCTGATGGCGCGAGG<br>GAGGC |
| hsIGL_0231_V021_J007_IGLV03-25_IGLJ7_F | GCCTTGCCAGCCCGCTCAGTCCGTCTACGTTACTTTTGCAGGCTCTGAG SEQ ID NO:<br>GCCTCCTATGAGCTGACACAGCCACCCTCGGTGTCAGTGTCCCCAGGAC 6052<br>AGACGGCCAGGATCACCTGCTCTGGAGATGCATTGCCAAAGCAATATGC<br>TTATTGGTACCAGCAGAAGCCAGGCCAGGCCCCTGTGCTGGTGATATAT<br>AAAGACAGTGAGAGGCCCTCAGGGATCCCTGAGCGATTCTCTGGCTCCA<br>GCTCAGGGACAACAGTCACGTTGACCATCAGTGGAGTCCAGGCAGAAGA<br>TGAGGCTGACTATTACTGTCAATCAGCAGACAGCAGTGGTATGATCCGT<br>CTACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTCCGTCTACGTTACTTCTGATGGCGCGAGG<br>GAGGC |
| hsIGL_0232_V022_J007_IGLV03-27_IGLJ7_F | GCCTTGCCAGCCCGCTCAGAAGAGCTGCGTTACTTCTTTTCTTGCAGTC SEQ ID NO:<br>TCTGTGGCCTCCTATGAGCTGACACAGCCATCCTCAGTGTCAGTGTCTC 6053<br>CGGGACAGACAGCCAGGATCACCTGCTCAGGAGATGTACTGGCAAAAAA<br>ATATGCTCGGTGGTTCCAGCAGAAGCCAGGCCAGGCCCCTGTGCTGGTG<br>ATTTATAAAGACAGTGAGCGGCCCTCAGGGATCCCTGAGCGATTCTCCG<br>GCTCCAGCTCAGGGACCACAGTCACCTTGACCATCAGCGGGGCCCAGGT<br>TGAGGATGAGGCTGACTATTACTGTTACTCTGCGGCTGACATGAAAGAG<br>CTGCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGAAGAGCTGCGTTACTTCTGATGGCGCGAGG<br>GAGGC |

| INFORMAL SEQUENCE LISTING | |
|---|---|
| hsIGL_0233_V023_J007_IGLV04-03_IGLJ7_F | GCCTTGCCAGCCCGCTCAGTATCGCTCCGTTACTTTGCTGACTCAGCCC CCGTCTGCATCTGCCTTGCTGGGAGCCTCGATCAAGCTCACCTGCACCC TAAGCAGTGAGCACAGCACCTACACCATCGAATGGTATCAACAGAGACC AGGGAGGTCCCCCCAGTATATAATGAAGGTTAAGAGTGATGGCAGCCAC AGCAAGGGGGACGGGATCCCCGATCGCTTCATGGGCTCCAGTTCTGGGG CTGACCGCTACCTCACCTTCTCCAACCTCCAGTCTGACGATGAGGCTGA GTATCACTGTGGAGAGAGCCACACGATTGATGGCCAAGTCGTGATATCG CTCCGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGTATCGCTCCGTTACTTCTGATGGCGCGAGG GAGGC SEQ ID NO: 6054 |
| hsIGL_0234_V024_J007_IGLV04-60_IGLJ7_F | GCCTTGCCAGCCCGCTCAGTCAGATGCCGTTACTTCTCTCTCCCAGCCT GTGCTGACTCAATCATCCTCTGCCTCTGCTTCCCTGGGATCCTCGGTCA AGCTCACCTGCACTCTGAGCAGTGGGCACAGTAGCTACATCATCGCATG GCATCAGCAGCAGCCAGGGAAGGCCCCTCGGTACTTGATGAAGCTTGAA GGTAGTGGAAGCTACAACAAGGGGAGCGGAGTTCCTGATCGCTTCTCAG GCTCCAGCTCTGGGGCTGACCGCTACCTCACCATCTCCAACCTCCAGTT TGAGGATGAGGCTGATTATTACTGTGAGACCTGGGACAGTATGATCAGA TGCCGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGTCAGATGCCGTTACTTCTGATGGCGCGAGG GAGGC SEQ ID NO: 6055 |
| hsIGL_0235_V025_J007_IGLV04-69_IGLJ7_F | GCCTTGCCAGCCCGCTCAGGTGTAGCACGTTACTTCTCTCTCCCAGCTT GTGCTGACTCAATCGCCCTCTGCCTCTGCCTCCCTGGGAGCCTCGGTCA AGCTCACCTGCACTCTGAGCAGTGGGCACAGCAGCTACGCCATCGCATG GCATCAGCAGCAGCCAGAGAAGGGCCCTCGGTACTTGATGAAGCTTAAC AGTGATGGCAGCCACAGCAAGGGGGACGGGATCCCTGATCGCTTCTCAG GCTCCAGCTCTGGGGCTGAGCGCTACCTCACCATCTCCAGCCTCCAGTC TGAGGATGAGGCTGACTATTACTGTCAGACCTGGGGCACTGTGAGTGTA GCACGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGGTGTAGCACGTTACTTCTGATGGCGCGAGG GAGGC SEQ ID NO: 6056 |
| hsIGL_0236_V026_J007_IGLV05-37_IGLJ7_F | GCCTTGCCAGCCCGCTCAGTGGCAGTTCGTTACTTTGTGCTGACTCAGC CACCTTCCTCCTCCGCATCTCCTGGAGAATCCGCCAGACTCACCTGCAC CTTGCCCAGTGACATCAATGTTGGTAGCTACAACATATACTGGTACCAG CAGAAGCCAGGGAGCCCTCCCAGGTATCTCCTGTACTACTACTCAGACT CAGATAAGGGCCAGGGCTCTGGAGTCCCCAGCCGCTTCTCTGGATCCAA AGATGCTTCAGCCAATCAGGGATTTTACTCATCTCCGGGCTCCAGTCT GAGGATGAGGCTGACTATTACTGTATGATTTGGCCAAGCAATGATGGCA GTTCGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGTGGCAGTTCGTTACTTCTGATGGCGCGAGG GAGGC SEQ ID NO: 6057 |
| hsIGL_0237_V027_J007_IGLV05-39_IGLJ7_F | GCCTTGCCAGCCCGCTCAGCAGTCCAACGTTACTTTGTGCTGACTCAGC CAACCTCCCTCTCAGCATCTCCTGGAGCATCAGCCAGATTCACCTGCAC CTTGCGCAGCGGCATCAATGTTGGTACCTACAGGATATACTGGTACCAG CAGAATCCAGGGAGTCTTCCCCGGTATCTCCTGAGGTACAAATCAGACT CAGATAAGCAGCAGGGCTCTGGAGTCCCCAGCCGCTTCTCTGGATCCAA AGATGCTTCAACCAATGCAGGCCTTTTACTCATCTCTGGGCTCCAGTCT GAAGATGAGGCTGACTATTACTGTGCCATTTGGTACAGCAGTGACAGTC CAACGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGCAGTCCAACGTTACTTCTGATGGCGCGAGG GAGGC SEQ ID NO: 6058 |
| hsIGL_0238_V028_J007_IGLV05-45_IGLJ7_F | GCCTTGCCAGCCCGCTCAGTACGTACGCGTTACTTTGTGCTGACTCAGC CGTCTTCCCTCTCTGCATCTCCTGGAGCATCAGCCAGTCTCACCTGCAC CTTGCGCAGTGGCATCAATGTTGGTACCTACAGGATATACTGGTACCAG CAGAAGCCAGGGAGTCCTCCCCAGTATCTCCTGAGGTACAAATCAGACT CAGATAAGCAGCAGGGCTCTGGAGTCCCCAGCCGCTTCTCTGGATCCAA AGATGCTTCGGCCAATGCAGGGATTTTACTCATCTCTGGGCTCCAGTCT GAGGATGAGGCTGACTATTACTGTATGATTTGGCACAGCAGTGATACGT ACGCGTTACTTGTCGACTGTTCGGAGGAGGCACCCAGCTGACCGTCCTC GGTAAGTCTCCCCGCTTCTCTCCTCTTTGAGATCCCAAGTTAAACACGG GGAGTTTTTCCCTTTCCTGTACGTACGCGTTACTTCTGATGGCGCGAGG GAGGC SEQ ID NO: 6059 |
| hsIGL_0239_V029_J007_IGLV05-52_IGLJ7_F | GCCTTGCCAGCCCGCTCAGAGTACCGACGTTACTTTGACTCAGCCATCT TCCCATTCTGCATCTTCTGGAGCATCAGTCAGACTCACCTGCATGCTGA GCAGTGGCTTCAGTGTTGGGGACTTCTGGATAAGGTGGTACCAACAAAA GCCAGGGAACCCTCCCCGGTATCTCCTGTACTACCACTCAGACTCCAAT AAGGGGCCAAGGCTCTGGAGTTCCCAGCCGCTTCTCTGGATCCAACGATG SEQ ID NO: 6060 |

| | | |
|---|---|---|
| | CATCAGCCAATGCAGGGATTCTGCGTATCTCTGGGCTCCAGCCTGAGGA<br>TGAGGCTGACTATTACTGTGGTACATGGCACAGCAACTCTATGAAGTAC<br>CGACGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGAGTACCGACGTTACTTCTGATGGCGCGAGG<br>GAGGC | |
| hsIGL_0240_V030_J007_IGLV07-<br>43_IGLJ7_F | GCCTTGCCAGCCCGCTCAGATCCATGGCGTTACTTAGGGTCCAATTCTC<br>AGACTGTGGTGACTCAGGAGCCCTCACTGACTGTGTCCCCAGGAGGGAC<br>AGTCACTCTCACCTGTGCTTCCAGCACTGGAGCAGTCACCAGTGGTTAC<br>TATCCAAACTGGTTCCAGCAGAAACCTGGACAAGCACCCAGGGCACTGA<br>TTTATAGTACAAGCAACAAACACTCCTGGACCCCTGCCCGGTTCTCAGG<br>CTCCCTCCTTGGGGGCAAAGCTGCCCTGACACTGTCAGGTGTGCAGCCT<br>GAGGACGAGGCTGAGTATTACTGCCTGCTCTACTATGGTGGTGAATCCA<br>TGGCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGATCCATGGCGTTACTTCTGATGGCGCGAGG<br>GAGGC | SEQ ID NO:<br>6061 |
| hsIGL_0241_V031_J007_IGLV07-<br>46-<br>FP_IGLJ7_F | GCCTTGCCAGCCCGCTCAGGTAGCAGTCGTTACTTAGGGTCCAATTCCC<br>AGGCTGTGGTGACTCAGGAGCCCTCACTGACTGTGTCCCCAGGAGGGAC<br>AGTCACTCTCACCTGTGGCTCCAGCACTGGAGCTGTCACCAGTGGTCAT<br>TATCCCTACTGGTTCCAGCAGAAGCCTGGCCAAGCCCCAGGACACTGA<br>TTTATGATACAAGCAACAAACACTCCTGGACACCCTGCCCGGTTCTCAGG<br>CTCCCTCCTTGGGGGCAAAGCTGCCCTGACCCTTTTGGGTGCGCAGCCT<br>GAGGATGAGGCTGAGTATTACTGCTTGCTCTCCTATAGTGGTGAGTAGC<br>AGTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGGTAGCAGTCGTTACTTCTGATGGCGCGAGG<br>GAGGC | SEQ ID NO:<br>6062 |
| hsIGL_0242_V032_J007_IGLV08-<br>61_IGLJ7_F | GCCTTGCCAGCCCGCTCAGATCTTCGTCGTTACTTGAGTGGATTCTCAG<br>ACTGTGGTGACCCAGGAGCCATCGTTCTCAGTGTCCCCTGGAGGGACA<br>TCACACTCACTTGTGGCTTGAGCTCTGGCTCAGTCTCTACTAGTTACTA<br>CCCCAGCTGGTACCAGCAGACCCCAGGCCAGGCTCCACGCACGCTCATC<br>TACAGCACAAACACTCGCTCTTCTGGGGTCCCTGATTGCTTCTCTGGCT<br>CCATCCTTGGGAACAAAGCTGCCCTCACCATCACGGGGGCCCAGGCAGA<br>TGATGAATCTGATTATTACTGTGTGCTGTATATGGGTAGTGTGAATCTT<br>CGTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGATCTTCGTCGTTACTTCTGATGGCGCGAGG<br>GAGGC | SEQ ID NO:<br>6063 |
| hsIGL_0243_V033_J007_IGLV09-<br>49_IGLJ7_F | GCCTTGCCAGCCCGCTCAGTCCACAGTCGTTACTTTGACTCAGCCACCT<br>TCTGCATCAGCCTCCCTGGGAGCCTCGGTCACACTCACCTGCACCCTGA<br>GCAGCGGCTACAGTAATTATAAAGTGGACTGGTACCAGCAGAGACCAGG<br>GAAGGGCCCCCGGTTTGTGATGCGAGTGGGCACTGGTGGGATTGTGGGA<br>TCCAAGGGGGATGGCATCCCTGATCGCTTCTCAGTCTTGGGCTCAGGCC<br>TGAATCGGTACCTGACCATCAAGAACATCCAGGAAGAAGATGAGAGTGA<br>CTACCACTGTGGGGCAGACCATGGCAGTGGGAGCAACTTCGTGATCCAC<br>AGTCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGTCCACAGTCGTTACTTCTGATGGCGCGAGG<br>GAGGC | SEQ ID NO:<br>6064 |
| hsIGL_0244_V034_J007_IGLV10-<br>54-<br>FP_IGLJ7_F | GCCTTGCCAGCCCGCTCAGATGACACCCGTTACTTTGTCAGTGGTCCAG<br>GCAGGGCTGACTCAGCCACCCTCGGTCTCCAAGGGCTTGAGACAGACCG<br>CCACACTCACCTGCACTGGGAACAGCAACAATGTTGGCAACCAAGGAGC<br>AGCTTGGCCTGAGCAGCACCAGGGCCACCCTCCCAAACTCCTATCCTAC<br>AGGAATAACAACCGGCCCTCAGGGATCTCAGAGAGATTATCTGCATCCA<br>GGTCAGGAAACACAGCCTCCCTGACCATTACTGGACTCCAGCCTGAGGA<br>CGAGGCTGACTATTACTGCTCAGCATGGGACAGCAGCCTCATGAATGAC<br>ACCCGTTACTTGTCGACTGTTCGGAGGAGGCACCCAGCTGACCGTCCTC<br>GGTAAGTCTCCCCGCTTCTCTCCTCTTTGAGATCCCAAGTTAAACACGG<br>GGAGTTTTTCCCTTTCCTGATGACACCCGTTACTTCTGATGGCGCGAGG<br>GAGGC | SEQ ID NO:<br>6065 |
| hsIGL_0245_V035_J007_IGLV11-<br>55-<br>ORF_IGLJ7_F | GCCTTGCCAGCCCGCTCAGCTTCACGACGTTACTTCGTGCTGACTCAGC<br>CGCCCTCTCTGTCTGCATCCCCGGGAGCAACAGCCAGACTCCCCTGCAC<br>CCTGAGCAGTGACCTCAGTGTTGGTGGTAAAAACATGTTCTGGTACCAG<br>CAGAAGCCAGGGAGCTCTCCCAGGTTATTCCTGTATCACTACTCAGACT<br>CAGACAAGCAGCTGGGACCTGGGGTCCCAGTCGAGTCTCTGGCTCCAA<br>GGAGACCTCAAGTAACACAGCGTTTTTGCTCATCTCTGGGCTCCAGCCT<br>GAGGACGAGGCCGATTATTACTGCCAGGTGTACGAAAGTAGTGACTTCA<br>CGACGTTACTTGTCGACTGTTCGGAGGAGGCACCCAGCTGACCGTCCTC | SEQ ID NO:<br>6066 |

| | INFORMAL SEQUENCE LISTING | |
|---|---|---|
| | GGTAAGTCTCCCCGCTTCTCTCCTCTTTGAGATCCCAAGTTAAACACGG GGAGTTTTTCCCTTTCCTGCTTCACGACGTTACTTCTGATGGCGCGAGG GAGGC | |
| Bias Control Sequences for hs-IgK | | |
| Name | Sequence | SEQ ID NO |
| hsIGK_0001_V001_J001_IGKV1-05-F_IGKJ1 | GCCTTGCCAGCCCGCTCAGGTTCCGAAGACACTCTCCAATCTCAGGTGC CAAATGTGACATCCAGATGACCCAGTCTCCTTCCACCCTGTCTGCATCT GTAGGAGACAGAGTCACCATCACTTGCCGGGCCAGTCAGAGTATTAGTA GCTGGTTGGCCTGGTATCAGCAGAAACCAGGGAAAGCCCCTAAGCTCCT GATCTATAAGGCGTCTAGTTTAGAAAGTGGGGTCCCATCAAGGTTCAGC GGCAGTGGATCTGGGACAGAATTCACTCTCACCATCAGCAGCCTGCAGC CTGATGATTTTGCAACTTATTACTGCCAACAGTATAATAGTTGAGTTCC GAAGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAGTTCCGAAGACACTCTCTGATGGCGCGAGG GAGGC | SEQ ID NO: 6067 |
| hsIGK_0002_V002_J001_IGKV1-06-F_IGKJ1 | GCCTTGCCAGCCCGCTCAGCGTTACTTGACACTCTCCAATCTCAGGTGC CAGATGTGCCATCCAGATGACCCAGTCTCCATCCTCCCTGTCTGCATCT GTAGGAGACAGAGTCACCATCACTTGCCGGGCAAGTCAGGGCATTAGAA ATGATTTAGGCTGGTATCAGCAGAAACCAGGGAAAGCCCCTAAGCTCCT GATCTATGCTGCATCCAGTTTACAAAGTGGGGTCCCATCAAGGTTCAGC GGCAGTGGATCTGGCACAGATTTCACTCTCACCATCAGCAGCCTGCAGC CTGAAGATTTTGCAACTTATTACTGTCTACAAGATTACAATTGACGTTA CTTGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGACGTTACTTGACACTCTCTGATGGCGCGAGG GAGGC | SEQ ID NO: 6068 |
| hsIGK_0003_V003_J001_IGKV1-08-F_IGKJ1 | GCCTTGCCAGCCCGCTCAGTAGGAGACGACACTCTCCAATCTCAGGTGC CAGATGTGCCATCCGGATGACCCAGTCTCCATCCTCATTCTCTGCATCT ACAGGAGACAGAGTCACCATCACTTGTCGGGCGAGTCAGGGTATTAGCA GTTATTTAGCCTGGTATCAGCAAAAACCAGGGAAAGCCCCTAAGCTCCT GATCTATGCTGCATCCACTTTGCAAAGTGGGGTCCCATCAAGGTTCAGC GGCAGTGGATCTGGGACAGATTTCACTCTCACCATCAGCTGCCTGCAGT CTGAAGATTTTGCAACTTATTACTGTCAACAGTATTATAGTTGATAGGA GACGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGATAGGAGACGACACTCTCTGATGGCGCGAGG GAGGC | SEQ ID NO: 6069 |
| hsIGK_0004_V004_J001_IGKV1-09-F_IGKJ1 | GCCTTGCCAGCCCGCTCAGGTGTCTACGACACTCTCCAATCTCAGGTGC CAGATGTGACATCCAGTTGACCCAGTCTCCATCCTTCCTGTCTGCATCT GTAGGAGACAGAGTCACCATCACTTGCCGGGCCAGTCAGGGCATTAGCA GTTATTTAGCCTGGTATCAGCAAAAACCAGGGAAAGCCCCTAAGCTCCT GATCTATGCTGCATCCACTTTGCAAAGTGGGGTCCCATCAAGGTTCAGC GGCAGTGGATCTGGGACAGAATTCACTCTCACAATCAGCAGCCTGCAGC CTGAAGATTTTGCAACTTATTACTGTCAACAGCTTAATAGTTGAGTGTC TACGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAGTGTCTACGACACTCTCTGATGGCGCGAGG GAGGC | SEQ ID NO: 6070 |
| hsIGK_0005_V005_J001_IGKV1-12-F_IGKJ1 | GCCTTGCCAGCCCGCTCAGGTACAGTGGACACTCTCCAATCTCAGGTTC CAGATGCGACATCCAGATGACCCAGTCTCCATCTTCCGTGTCTGCATCT GTAGGAGACAGAGTCACCATCACTTGTCGGGCGAGTCAGGGTATTAGCA GCTGGTTAGCCTGGTATCAGCAGAAACCAGGGAAAGCCCCTAAGCTCCT GATCTATGCTGCATCCAGTTTGCAAAGTGGGGTCCCATCAAGGTTCAGC GGCAGTGGATCTGGGACAGATTTCACTCTCACCATCAGCAGCCTGCAGC CTGAAGATTTTGCAACTTACTATTGTCAACAGGCTAACAGTTGAGTACA GTGGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAGTACAGTGGACACTCTCTGATGGCGCGAGG GAGGC | SEQ ID NO: 6071 |
| hsIGK_0006_V006_J001_IGKV1-13-FP_IGKJ1 | GCCTTGCCAGCCCGCTCAGGGATCATCGACACTCTCCAATCTCAGGTGC CAGATGTGCCATCCAGTTGACCCAGTCTCCATCTCCCGTGTCTGCATCT GTAGGAGACAGAGTCACCATCACTTGCCGGGCAAGTCAGGGCATTAGCA GTGCTTTAGCCTGATATCAGCAGAAACCAGGGAAAGCTCCTAAGCTCCT GATCTATGATGCCTCCAGTTTGGAAAGTGGGGTCCCATCAAGGTTCAGC GGCAGTGGATCTGGGACAGACTTCACTCTCACCATCAGCAGCCTGCAGC CTGAAGATTTTGCAACTTATTACTGTCAACAGTTTAATAATTGAGGATC ATCGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAGGATCATCGACACTCTCTGATGGCGCGAGG GAGGC | SEQ ID NO: 6072 |

| INFORMAL SEQUENCE LISTING | | |
|---|---|---|
| hsIGK_0007_V007_J001_IGKV1-16-F_IGKJ1 | GCCTTGCCAGCCCGCTCAGTATTGGCGGACACTCTCCAATCTCAGGTGC CAGATGTGACATCCAGATGACCCAGTCTCCATCCTCACTGTCTGCATCT GTAGGAGACAGAGTCACCATCACTTGTCGGGCGAGTCAGGGCATTAGCA ATTATTTAGCCTGGTTTCAGCAGAAACCAGGGAAAGCCCCTAAGTCCCT GATCTATGCTGCATCCAGTTTGCAAAGTGGGGTCCCATCAAAGTTCAGC GGCAGTGGATCTGGGACAGATTTCACTCTCACCATCAGCAGCCTGCAGC CTGAAGATTTTGCAACTTATTACTGCCAACAGTATAATAGTTGATATTG GCGGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGATATTGGCGGACACTCTCTGATGGCGCGAGG GAGGC | SEQ ID NO: 6073 |
| hsIGK_0008_V008_J001_IGKV1-17-F_IGKJ1 | GCCTTGCCAGCCCGCTCAGAGGCTTGAGACACTCTCCAATCTCAGGTGC CAGGTGTGACATCCAGATGACCCAGTCTCCATCCTCCCTGTCTGCATCT GTAGGAGACAGAGTCACCATCACTTGCCGGGCAAGTCAGGGCATTAGAA ATGATTTAGGCTGGTATCAGCAGAAACCAGGGAAAGCCCCTAAGCGCCT GATCTATGCTGCATCCAGTTTGCAAAGTGGGGTCCCATCAAGGTTCAGC GGCAGTGGATCTGGGACAGAATTCACTCTCACAATCAGCAGCCTGCAGC CTGAAGATTTTGCAACTTATTACTGTCTACAGCATAATAGTTGAAGGCT TGAGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAAGGCTTGAGACACTCTCTGATGGCGCGAGG GAGGC | SEQ ID NO: 6074 |
| hsIGK_0009_V009_J001_IGKV1-27-F_IGKJ1 | GCCTTGCCAGCCCGCTCAGACACACGTGACACTCTCTAATATCAGATAC CAGATGTGACATCCAGATGACCCAGTCTCCATCCTCCCTGTCTGCATCT GTAGGAGACAGAGTCACCATCACTTGCCGGGCGAGTCAGGGCATTAGCA ATTATTTAGCCTGGTATCAGCAGAAACCAGGGAAAGTTCCTAAGCTCCT GATCTATGCTGCATCCACTTTGCAATCAGGGGTCCCATCTCGGTTCAGT GGCAGTGGATCTGGGACAGATTTCACTCTCACCATCAGCAGCCTGCAGC CTGAAGATGTTGCAACTTATTACTGTCAAAAGTATAACAGTTGAACACA CGTGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAACACACGTGACACTCTCTGATGGCGCGAGG GAGGC | SEQ ID NO: 6075 |
| hsIGK_0010_V010_J001_IGKV1-33-F_IGKJ1 | GCCTTGCCAGCCCGCTCAGTAGACGGAGACACTCTCTAATCGCAGGTGC CAGATGTGACATCCAGATGACCCAGTCTCCATCCTCCCTGTCTGCATCT GTAGGAGACAGAGTCACCATCACTTGCCAGGCGAGTCAGGACATTAGCA ACTATTTAAATTGGTATCAGCAGAAACAGGGAAAGCCCCTAAGCTCCT GATCTACGATGCATCCAATTTGGAAACAGGGGTCCCATCAAGGTTCAGT GGAAGTGGATCTGGGACAGATTTTACTTTCACCATCAGCAGCCTGCAGC CTGAAGATATTGCAACATATTACTGTCAACAGTATGATAATTGATAGAC GGAGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGATAGACGGAGACACTCTCTGATGGCGCGAGG GAGGC | SEQ ID NO: 6076 |
| hsIGK_0011_V011_J001_IGKV1-37-O_IGKJ1 | GCCTTGCCAGCCCGCTCAGCAGCTCTTGACACTCTCCAATCTCAGGTGC CAGATGTGACATCCAGTTGACCCAGTCTCCATCCTCCCTGTCTGCATCT GTAGGAGACAGAGTCACCATCACTTGCCGGGTGAGTCAGGGCATTAGCA GTTATTTAAATTGGTATCGGCAGAAACAGGGAAAGTTCCTAAGCTCCT GATCTATAGTGCATCCAATTTGCAATCTGGAGTCCCATCTCGGTTCAGT GGCAGTGGATCTGGGACAGATTTCACTCTCACTATCAGCAGCCTGCAGC CTGAAGATGTTGCAACTTATTACGGTCAACGGACTTACAATTGACAGCT CTTGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGACAGCTCTTGACACTCTCTGATGGCGCGAGG GAGGC | SEQ ID NO: 6077 |
| hsIGK_0012_V012_J001_IGKV1-39-FP_IGKJ1 | GCCTTGCCAGCCCGCTCAGGAGCGATAGACACTCTCCAATCTCAGGTGC CAGATGTGACATCCAGATGACCCAGTCTCCATCCTCCCTGTCTGCATCT GTAGGAGACAGAGTCACCATCACTTGCCGGGCAAGTCAGAGCATTAGCA GCTATTTAAATTGGTATCAGCAGAAACCAGGGAAAGCCCCTAAGCTCCT GATCTATGCTGCATCCAGTTTGCAAAGTGGGGTCCCATCAAGGTTCAGT GGCAGTGGATCTGGGACAGATTTCACTCTCACCATCAGCAGTCTGCAAC CTGAAGATTTTGCAACTTACTACTGTCAACAGAGTTACAGTTGAGAGCG ATAGACACTCTGTCGACCGTTCGGCCAAGGGACCAAGGTGGAAATCAAA CGTGAGTAGAATTTAAACTTTGCTTCCTCAGTTGTCTGTGTCTTCTGTT CCCTGTGTCTATGAAGTGAGAGCGATAGACACTCTCTGATGGCGCGAGG GAGGC | SEQ ID NO: 6078 |
| hsIGK_0013_V013_J001_IGKV1-NL1-F_IGKJ1 | GCCTTGCCAGCCCGCTCAGGCATCTGAGACACTCTCCAATCTCAGGTAC CAGATGTGACATCCAGATGACCCAGTCTCCATCCTCCCTGTCTGCATCT GTAGGAGACAGAGTCACCATCACTTGCCGGGCGAGTCAGGGCATTAGCA ATTCTTTAGCCTGGTATCAGCAGAAACCAGGGAAAGCCCCTAAGCTCCT | SEQ ID NO: 6079 |

| | INFORMAL SEQUENCE LISTING | |
|---|---|---|
| | GCTCTATGCTGCATCCAGATTGGAAAGTGGGGTCCCATCCAGGTTCAGT<br>GGCAGTGGATCTGGGACGGATTACACTCTCACCATCAGCAGCCTGCAGC<br>CTGAAGATTTTGCAACTTATTACTGTCAACAGTATTATAGTTGAGCATC<br>TGAGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGAGCATCTGAGACACTCTCTGATGGCGCGAGG<br>GAGGC | |
| hsIGK_0014_V014_J001_IGKV2-<br>24-<br>F_IGKJ1 | GCCTTGCCAGCCCGCTCAGTGCTACACGACACTCTAGTGGGGATATTGT<br>GATGACCCAGACTCCACTCTCCTCACCTGTCACCCTTGGACAGCCGGCC<br>TCCATCTCCTGCAGGTCTAGTCAAAGCCTCGTACACAGTGATGGAAACA<br>CCTACTTGAGTTGGCTTCAGCAGAGGCCAGGCCAGCCTCCAAGACTCCT<br>AATTTATAAGATTTCTAACCGGTTCTCTGGGGTCCCAGACAGATTCAGT<br>GGCAGTGGGGCAGGGACAGATTTCACACTGAAAATCAGCAGGGTGGAAG<br>CTGAGGATGTCGGGGTTTATTACTGCATGCAAGCTACACAATGATGCTA<br>CACGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGATGCTACACGACACTCTCTGATGGCGCGAGG<br>GAGGC | SEQ ID NO:<br>6080 |
| hsIGK_0015_V015_J001_IGKV2-<br>28-<br>F_IGKJ1 | GCCTTGCCAGCCCGCTCAGAACTGCCAGACACTCTAGTGGGGATATTGT<br>GATGACTCAGTCTCCACTCTCCCTGCCCGTCACCCCTGGAGAGCCGGCC<br>TCCATCTCCTGCAGGTCTAGTCAGAGCCTCCTGCATAGTAATGGATACA<br>ACTATTTGGATTGGTACCTGCAGAAGCCAGGGCAGTCTCCACAGCTCCT<br>GATCTATTTGGGTTCTAATCGGGCCTCCGGGGTCCCTGACAGGTTCAGT<br>GGCAGTGGATCAGGCACAGATTTTACACTGAAAATCAGCAGAGTGGAGG<br>CTGAGGATGTTGGGGTTTATTACTGCATGCAAGCTCTACAATGAAACTG<br>CCAGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGAAACTGCCAGACACTCTCTGATGGCGCGAGG<br>GAGGC | SEQ ID NO:<br>6081 |
| hsIGK_0016_V016_J001_IGKV2-<br>29-<br>FP_IGKJ1 | GCCTTGCCAGCCCGCTCAGTTGGACTGGACACTCTAGTGCGGATATTGT<br>GATGACCCAGACTCCACTCTCTCTGTCCGTCACCCCTGGACAGCCGGCC<br>TCCATCTCCTGCAAGTCTAGTCAGAGCCTCCTGCATAGTGATGGAAAGA<br>CCTATTTGTATTGGTACCTGCAGAAGCCAGGCCAGTCTCCACAGCTCCT<br>GATCTATGAAGTTTCCAGCCGGTTCTCTGGAGTGCCAGATAGGTTCAGT<br>GGCAGCGGGTCAGGGACAGATTTCACACTGAAAATCAGCGGGTGGAGG<br>CTGAGGATGTTGGGGTTTATTACTGAATGCAAGGTATACACTGATTGGA<br>CTGGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGATTGGACTGGACACTCTCTGATGGCGCGAGG<br>GAGGC | SEQ ID NO:<br>6082 |
| hsIGK_0017_V017_J001_IGKV2-<br>30-<br>F_IGKJ1 | GCCTTGCCAGCCCGCTCAGGTAGACACGACACTCTAGTGGGGATGTTGT<br>GATGACTCAGTCTCCACTCTCCCTGCCCGTCACCCTTGGACAGCCGGCC<br>TCCATCTCCTGCAGGTCTAGTCAAAGCCTCGTATACAGTGATGGAAACA<br>CCTACTTGAATTGGTTTCAGCAGAGGCCAGGCCAATCTCCAAGGCGCCT<br>AATTTATAAGGTTTCTAACCGGGACTCTGGGGTCCCAGACAGATTCAGC<br>GGCAGTGGGTCAGGCACTGATTTCACACTGAAAATCAGCAGGGTGGAGG<br>CTGAGGATGTTGGGGTTTATTACTGCATGCAAGGTACACACTGAGTAGA<br>CACGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGAGTAGACACGACACTCTCTGATGGCGCGAGG<br>GAGGC | SEQ ID NO:<br>6083 |
| hsIGK_0018_V018_J001_IGKV2-<br>40-<br>F_IGKJ1 | GCCTTGCCAGCCCGCTCAGCACTGTACGACACTCTGAGGATATTGTGAT<br>GACCCAGACTCCACTCTCCCTGCCCGTCACCCCTGGAGAGCCGGCCTCC<br>ATCTCCTGCAGGTCTAGTCAGAGCCTCTTGGATAGTGATGATGGAAACA<br>CCTATTTGGACTGGTACCTGCAGAAGCCAGGGCAGTCTCCACAGCTCCT<br>GATCTATACGCTTTCCTATCGGGCCTCTGGAGTCCCAGACAGGTTCAGT<br>GGCAGTGGGTCAGGCACTGATTTCACACTGAAAATCAGCAGGGTGGAGG<br>CTGAGGATGTTGGAGTTTATTACTGCATGCAACGTATAGAGTGACACTG<br>TACGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGACACTGTACGACACTCTCTGATGGCGCGAGG<br>GAGGC | SEQ ID NO:<br>6084 |
| hsIGK_0019_V019_J001_IGKV3-<br>07-<br>F_IGKJ1 | GCCTTGCCAGCCCGCTCAGGATGATCCGACACTCTATCTCAGATACCAC<br>CGGAGAAATTGTAATGACACAGTCTCCAGCCACCCTGTCTTTGTCTCCA<br>GGGGAAAGAGCCACCCTCTCCTGCAGGGCCAGTCAGAGTGTTAGCAGCA<br>GCTACTTATCCTGGTACCAGCAGAAACCTGGGCAGGCTCCCAGGCTCCT<br>CATCTATGGTGCATCCACCAGGGCCACTGGCATCCCAGCCAGGTTCAGT<br>GGCAGTGGGTCTGGGACAGACTTCACTCTCACCATCAGCAGCCTGCAGC<br>CTGAAGATTTTGCAGTTTATTACTGTCAGCAGGATTATAACTGAGATGA<br>TCCGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT | SEQ ID NO:<br>6085 |

| INFORMAL SEQUENCE LISTING | |
|---|---|
| | CCCTGTGTCTATGAAGTGAGATGATCCGACACTCTCTGATGGCGCGAGG<br>GAGGC |
| hsIGK_0020_V020_J001_IGKV3-<br>11-<br>F_IGKJ1 | GCCTTGCCAGCCCGCTCAGCGCCAATAGACACTCTCCAATTTCAGATAC SEQ ID NO:<br>CACCGGAGAAATTGTGTTGACACAGTCTCCAGCCACCCTGTCTTTGTCT 6086<br>CCAGGGGAAAGAGCCACCCTCTCCTGCAGGGCCAGTCAGAGTGTTAGCA<br>GCTACTTAGCCTGGTACCAACAGAAACCTGGCCAGGCTCCCAGGCTCCT<br>CATCTATGATGCATCCAACAGGGCCACTGGCATCCCAGCCAGGTTCAGT<br>GGCAGTGGGTCTGGGACAGACTTCACTCTCACCATCAGCAGCCTAGAGC<br>CTGAAGATTTTGCAGTTTATTACTGTCAGCAGCGTAGCAACTGACGCCA<br>ATAGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGACGCCAATAGACACTCTCTGATGGCGCGAGG<br>GAGGC |
| hsIGK_0021_V021_J001_IGKV3-<br>15-<br>F_IGKJ1 | GCCTTGCCAGCCCGCTCAGTCAAGCCTGACACTCTCCAATTTCAGATAC SEQ ID NO:<br>CACTGGAGAAATAGTGATGACGCAGTCTCCAGCCACCCTGTCTGTGTCT 6087<br>CCAGGGGAAAGAGCCACCCTCTCCTGCAGGGCCAGTCAGAGTGTTAGCA<br>GCAACTTAGCCTGGTACCAGCAGAAACCTGGCCAGGCTCCCAGGCTCCT<br>CATCTATGGTGCATCCACCAGGGCCACTGGTATCCCAGCCAGGTTCAGT<br>GGCAGTGGGTCTGGGACAGAGTTCACTCTCACCATCAGCAGCCTGCAGT<br>CTGAAGATTTTGCAGTTTATTACTGTCAGCAGTATAATAACTGATCAAG<br>CCTGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGATCAAGCCTGACACTCTCTGATGGCGCGAGG<br>GAGGC |
| hsIGK_0022_V022_J001_IGKV3-<br>20-<br>F_IGKJ1 | GCCTTGCCAGCCCGCTCAGACGTGTGTGACACTCTATCTCAGATACCAC SEQ ID NO:<br>CGGAGAAATTGTGTTGACGCAGTCTCCAGGCACCCTGTCTTTGTCTCCA 6088<br>GGGGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTCCT<br>CATCTATGGTGCATCCAGCAGGGCCACTGGCATCCCAGACAGGTTCAGT<br>GGCAGTGGGTCTGGGACAGACTTCACTCTCACCATCAGCAGACTGGAGC<br>CTGAAGATTTTGCAGTGTATTACTGTCAGCAGTATGGTAGCTGAACGTG<br>TGTGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGAACGTGTGTGACACTCTCTGATGGCGCGAGG<br>GAGGC |
| hsIGK_0023_V023_J001_IGKV3-<br>NL4-<br>FNG_IGKJ1 | GCCTTGCCAGCCCGCTCAGTCCGTCTAGACACTCTCCAATTTCAGATAC SEQ ID NO:<br>CACCGGAGAAATTGTGTTGACACAGTCTCCAGCCACCCTGTCTTTGTCT 6089<br>CCAGGGGAAAGAGCCACCCTCTCCTGCAGGGCCAGTCAGGGTGTTAGCA<br>GCTACTTAGCCTGGTACCAGCAGAAACCTGGCCAGGCTCCCAGGCTCCT<br>CATCTATGATGCATCCAACAGGGCCACTGGCATCCCAGCCAGGTTCAGT<br>GGCAGTGGGCCTGGGACAGACTTCACTCTCACCATCAGCAGCCTAGAGC<br>CTGAAGATTTTGCAGTTTATTACTGTCAGCAGCGTAGCAACTGATCCGT<br>CTAGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGATCCGTCTAGACACTCTCTGATGGCGCGAGG<br>GAGGC |
| hsIGK_0024_V024_J001_IGKV4-<br>01-<br>F_IGKJ1 | GCCTTGCCAGCCCGCTCAGAAGAGCTGGACACTCTGGGGACATCGTGAT SEQ ID NO:<br>GACCCAGTCTCCAGACTCCCTGGCTGTGTCTCTGGGCGAGAGGGCCACC 6090<br>ATCAACTGCAAGTCCAGCCAGAGTGTTTTATACAGCTCCAACAATAAGA<br>ACTACTTAGCTTGGTACCAGCAGAAACCAGGACAGCCTCCTAAGCTGCT<br>CATTTACTGGGCATCTACCCGGGAATCCGGGGTCCCTGACCGATTCAGT<br>GGCAGCGGGTCTGGGACAGATTTCACTCTCACCATCAGCAGCCTGCAGG<br>CTGAAGATGTGGCAGTTTATTACTGTCAGCAATATTATAGTTGAAAGAG<br>CTGGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGAAAGAGCTGGACACTCTCTGATGGCGCGAGG<br>GAGGC |
| hsIGK_0025_V025_J001_IGKV5-<br>02-<br>F_IGKJ1 | GCCTTGCCAGCCCGCTCAGTATCGCTCGACACTCTCCATAATCAGATAC SEQ ID NO:<br>CAGGGCAGAAACGACACTCACGCAGTCTCCAGCATTCATGTCAGCGACT 6091<br>CCAGGAGACAAAGTCAACATCTCCTGCAAAGCCAGCCAAGACATTGATG<br>ATGATATGAACTGGTACCAACAGAAACCAGGAGAAGCTGCTATTTTCAT<br>TATTCAAGAAGCTACTACTCTCGTTCCTGGAATCCCACCTCGATTCAGT<br>GGCAGCGGGTATGGAACAGATTTTACCCTCACAATTAATAACATAGAAT<br>CTGAGGATGCTGCATATTACTTCTGTCTACAACATGATAATTGATATCG<br>CTCGACACTCTGTCGACCGTTCGGCCAAGGGACCAAGGTGGAAATCAAA<br>CGTGAGTAGAATTTAAACTTTGCTTCCTCAGTTGTCTGTGTCTTCTGTT<br>CCCTGTGTCTATGAAGTGATATCGCTCGACACTCTCTGATGGCGCGAGG<br>GAGGC |

INFORMAL SEQUENCE LISTING

| | | |
|---|---|---|
| hsIGK_0026_V001_J002_IGKV1-05-F_IGKJ2 | GCCTTGCCAGCCCGCTCAGGTTCCGAATTCGGAACCCAATCTCAGGTGC<br>CAAATGTGACATCCAGATGACCCAGTCTCCTTCCACCCTGTCTGCATCT<br>GTAGGAGACAGAGTCACCATCACTTGCCGGGCCAGTCAGAGTATTAGTA<br>GCTGGTTGGCCTGGTATCAGCAGAAACCAGGGAAAGCCCCTAAGCTCCT<br>GATCTATAAGGCGTCTAGTTTAGAAAGTGGGGTCCCATCAAGGTTCAGC<br>GGCAGTGGATCTGGGACAGAATTCACTCTCACCATCAGCAGCCTGCAGC<br>CTGATGATTTTGCAACTTATTACTGCCAACAGTATAATAGTTGAGTTCC<br>GAATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGTTCCGAATTCGGAACCTGATGGCGCGAGG<br>GAGGC | SEQ ID NO:<br>6092 |
| hsIGK_0027_V002_J002_IGKV1-06-F_IGKJ2 | GCCTTGCCAGCCCGCTCAGCGTTACTTTTCGGAACCCAATCTCAGGTGC<br>CAGATGTGCCATCCAGATGACCCAGTCTCCATCCTCCCTGTCTGCATCT<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCTCCT<br>GATCTATGCTGCATCCAGTTTACAAAGTGGGGTCCCATCAAGGTTCAGC<br>GGCAGTGGATCTGGCACAGATTTCACTCTCACCATCAGCAGCCTGCAGC<br>CTGAAGATTTTGCAACTTATTACTGTCTACAAGATTACAATTGACGTTA<br>CTTTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGCGTTACTTTTCGGAACCTGATGGCGCGAGG<br>GAGGC | SEQ ID NO:<br>6093 |
| hsIGK_0028_V003_J002_IGKV1-08-F_IGKJ2 | GCCTTGCCAGCCCGCTCAGTAGGAGACTTCGGAACCCAATCTCAGGTGC<br>CAGATGTGCCATCCGGATGACCCAGTCTCCATCCTCATTCTCTGCATCT<br>ACAGGAGACAGAGTCACCATCACTTGTCGGGCGAGTCAGGGTATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGATTTCACTCTCACCATCAGCTGCCTGCAGT<br>CTGAAGATTTTGCAACTTATTACTGTCAACAGTATTATAGTTGATAGGA<br>GACTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTAGGAGACTTCGGAACCTGATGGCGCGAGG<br>GAGGC | SEQ ID NO:<br>6094 |
| hsIGK_0029_V004_J002_IGKV1-09-F_IGKJ2 | GCCTTGCCAGCCCGCTCAGGTGTCTACTTCGGAACCCAATCTCAGGTGC<br>CAGATGTGACATCCAGTTGACCCAGTCTCCATCCTTCCTGTCTGCATCT<br>GTAGGAGACAGAGTCACCATCACTTGCCGGGCCAGTCAGGGCATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCAACAGCTTAATAGTTGAGTGTC<br>TACTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGTGTCTACTTCGGAACCTGATGGCGCGAGG<br>GAGGC | SEQ ID NO:<br>6095 |
| hsIGK_0030_V005_J002_IGKV1-12-F_IGKJ2 | GCCTTGCCAGCCCGCTCAGGTACAGTGTTCGGAACCCAATCTCAGGTTC<br>CAGATGCGACATCCAGATGACCCAGTCTCCATCTTCCGTGTCTGCATCT<br>GTAGGAGACAGAGTCACCATCACTTGTCGGGCGAGTCAGGGTATTAGCA<br>GCTGGTTAGCCTGGTATCAGCAGAAACCAGGGAAAGCCCCTAAGCTCCT<br>GATCTATGCTGCATCCAGTTTGCAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTACTATTGTCAACAGGCTAACAGTTGAGTACA<br>GTGTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGTACAGTGTTCGGAACCTGATGGCGCGAGG<br>GAGGC | SEQ ID NO:<br>6096 |
| hsIGK_0031_V006_J002_IGKV1-13-FP_IGKJ2 | GCCTTGCCAGCCCGCTCAGGGATCATCTTCGGAACCCAATCTCAGGTGC<br>CAGATGTGCCATCCAGTTGACCCAGTCTCCATCCTCCCTGTCTGCATCT<br>GTAGGAGACAGAGTCACCATCACTTGCCGGGCAAGTCAGGGCATTAGCA<br>GTGCTTTAGCCTGATATCAGCAGAAACCAGGGAAAGCTCCTAAGCTCCT<br>GATCTATGATGCCTCCAGTTTGGAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTATTACTGTCAACAGTTTAATAATTGAGGATC<br>ATCTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGGATCATCTTCGGAACCTGATGGCGCGAGG<br>GAGGC | SEQ ID NO:<br>6097 |
| hsIGK_0032_V007_J002_IGKV1-16-F_IGKJ2 | GCCTTGCCAGCCCGCTCAGTATTGGCGTTCGGAACCCAATCTCAGGTGC<br>CAGATGTGACATCCAGATGACCCAGTCTCCATCCTCACTGTCTGCATCT<br>GTAGGAGACAGAGTCACCATCACTTGTCGGGCGAGTCAGGGCATTAGCA<br>ATTATTTAGCCTGGTTTCAGCAGAAACCAGGGAAAGCCCCTAAGTCCCT | SEQ ID NO:<br>6098 |

| INFORMAL SEQUENCE LISTING | |
|---|---|
| | GATCTATGCTGCATCCAGTTTGCAAAGTGGGGTCCCATCAAGTTCAGC<br>GGCAGTGGATCTGGGACAGATTTCACTCTCACCATCAGCAGCCTGCAGC<br>CTGAAGATTTTGCAACTTATTACTGCCAACAGTATAATAGTTGATATTG<br>GCGTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTATTGGCGTTCGGAACCTGATGGCGCGAGG<br>GAGGC |
| hsIGK_0033_V008_J002_IGKV1-<br>17-<br>F_IGKJ2 | GCCTTGCCAGCCCGCTCAGAGGCTTGATTCGGAACCCAATCTCAGGTGC SEQ ID NO:<br>CAGGTGTGACATCCAGATGACCCAGTCTCCATCCTCCCTGTCTGCATCT 6099<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCGCCT<br>GATCTATGCTGCATCCAGTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCTACAGCATAATAGTTGAAGGCT<br>TGATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGAGGCTTGATTCGGAACCTGATGGCGCGAGG<br>GAGGC |
| hsIGK_0034_V009_J002_IGKV1-<br>27-<br>F_IGKJ2 | GCCTTGCCAGCCCGCTCAGACACACGTTTCGGAACCTAATATCAGATAC SEQ ID NO:<br>CAGATGTGACATCCAGATGACCCAGTCTCCATCCTCCCTGTCTGCATCT 6100<br>GTAGGAGACAGAGTCACCATCACTTGCCGGGCGAGTCAGGGCATTAGCA<br>ATTATTTAGCCTGGTATCAGCAGAAACCAGGGAAAGTTCCTAAGCTCCT<br>GATCTATGCTGCATCCACTTTGCAATCAGGGGTCCCATCTCGGTTCAGT<br>GGCAGTGGATCTGGGACAGATTTCACTCTCACCATCAGCAGCCTGCAGC<br>CTGAAGATGTTGCAACTTATTACTGTCAAAAGTATAACAGTTGAACACA<br>CGTTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGACACACGTTTCGGAACCTGATGGCGCGAGG<br>GAGGC |
| hsIGK_0035_V010_J002_IGKV1-<br>33-<br>F_IGKJ2 | GCCTTGCCAGCCCGCTCAGTAGACGGATTCGGAACCTAATCGCAGGTGC SEQ ID NO:<br>CAGATGTGACATCCAGATGACCCAGTCTCCATCCTCCCTGTCTGCATCT 6101<br>GTAGGAGACAGAGTCACCATCACTTGCCAGGCGAGTCAGGACATTAGCA<br>ACTATTTAAATTGGTATCAGCAGAAACCAGGGAAAGCCCCTAAGCTCCT<br>GATCTACGATGCATCCAATTTGGAAACAGGGGTCCCATCAAGGTTCAGT<br>GGAAGTGGATCTGGGACAGATTTTACTTTCACCATCAGCAGCCTGCAGC<br>CTGAAGATATTGCAACATATTACTGTCAACAGTATGATAATTGATAGAC<br>GGATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTAGACGGATTCGGAACCTGATGGCGCGAGG<br>GAGGC |
| hsIGK_0036_V011_J002_IGKV1-<br>37-<br>O_IGKJ2 | GCCTTGCCAGCCCGCTCAGCAGCTCTTTTCGGAACCCAATCTCAGGTGC SEQ ID NO:<br>CAGATGTGACATCCAGTTGACCCAGTCTCCATCCTCCCTGTCTGCATCT 6102<br>GTAGGAGACAGAGTCACCATCACTTGCCGGGTGAGTCAGGGCATTAGCA<br>GTTATTTAAATTGGTATCGGCAGAAACCAGGGAAAGTTCCTAAGCTCCT<br>GATCTATAGTGCATCCAATTTGCAATCTGGAGTCCCATCTCGGTTCAGT<br>GGCAGTGGATCTGGGACAGATTTCACTCTCACTATCAGCAGCCTGCAGC<br>CTGAAGATGTTGCAACTTATTCGGTCAACGGACTTACAATTGACAGCT<br>CTTTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGCAGCTCTTTTCGGAACCTGATGGCGCGAGG<br>GAGGC |
| hsIGK_0037_V012_J002_IGKV1-<br>39-<br>FP_IGKJ2 | GCCTTGCCAGCCCGCTCAGGAGCGATATTCGGAACCCAATCTCAGGTGC SEQ ID NO:<br>CAGATGTGACATCCAGATGACCCAGTCTCCATCCTCCCTGTCTGCATCT 6103<br>GTAGGAGACAGAGTCACCATCACTTGCCGGGCAAGTCAGAGCATTAGCA<br>GCTATTTAAATTGGTATCAGCAGAAACCAGGGAAAGCCCCTAAGCTCCT<br>GATCTATGCTGCATCCAGTTTGCAAAGTGGGGTCCCATCAAGGTTCAGT<br>GGCAGTGGATCTGGGACAGATTTCACTCTCACCATCAGCAGTCTGCAAC<br>CTGAAGATTTTGCAACTTACTACTGTCAACAGAGTTACAGTTGAGAGCG<br>ATATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGAGCGATATTCGGAACCTGATGGCGCGAGG<br>GAGGC |
| hsIGK_0038_V013_J002_IGKV1-<br>NL1-<br>F_IGKJ2 | GCCTTGCCAGCCCGCTCAGGCATCTGATTCGGAACCCAATCTCAGGTAC SEQ ID NO:<br>CAGATGTGACATCCAGATGACCCAGTCTCCATCCTCCCTGTCTGCATCT 6104<br>GTAGGAGACAGAGTCACCATCACTTGCCGGGCGAGTCAGGGCATTAGCA<br>ATTCTTTAGCCTGGTATCAGCAGAAACCAGGGAAAGCCCCTAAGCTCCT<br>GCTCTATGCTGCATCCAGATTGGAAAGTGGGGTCCCATCCAGGTTCAGT<br>GGCAGTGGATCTGGGACGGATTACACTCTCACCATCAGCAGCCTGCAGC<br>CTGAAGATTTTGCAACTTATTACTGTCAACAGTATTATAGTTGAGCATC |

| INFORMAL SEQUENCE LISTING | |
|---|---|
| | TGATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGCATCTGATTCGGAACCTGATGGCGCGAGG<br>GAGGC |
| hsIGK_0039_V014_J002_IGKV2-<br>24-<br>F_IGKJ2 | GCCTTGCCAGCCCGCTCAGTGCTACACTTCGGAACAGTGGGGATATTGT SEQ ID NO:<br>GATGACCCAGACTCCACTCTCCTCACCTGTCACCCTTGGACAGCCGGCC 6105<br>TCCATCTCCTGCAGGTCTAGTCAAAGCCTCGTACACAGTGATGGAAACA<br>CCTACTTGAGTTGGCTTCAGCAGAGGCCAGGCCAGCCTCCAAGACTCCT<br>AATTTATAAGATTTCTAACCGGTTCTCTGGGGTCCCAGACAGATTCAGT<br>GGCAGTGGGGCAGGGACAGATTTCACACTGAAAATCAGCAGGGTGGAAG<br>CTGAGGATGTCGGGGTTTATTACTGCATGCAAGCTACACAATGATGCTA<br>CACTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTGCTACACTTCGGAACCTGATGGCGCGAGG<br>GAGGC |
| hsIGK_0040_V015_J002_IGKV2-<br>28-<br>F_IGKJ2 | GCCTTGCCAGCCCGCTCAGAACTGCCATTCGGAACAGTGGGGATATTGT SEQ ID NO:<br>GATGACTCAGTCTCCACTCTCCCTGCCCGTCACCCCTGGAGAGCCGGCC 6106<br>TCCATCTCCTGCAGGTCTAGTCAGAGCCTCCTGCATAGTAATGATACA<br>ACTATTTGGATTGGTACCTGCAGAAGCCAGGGCAGTCTCCACAGCTCCT<br>GATCTATTTGGGTTCTAATCGGGCCTCCGGGGTCCCTGACAGGTTCAGT<br>GGCAGTGGATCAGGCACAGATTTTACACTGAAAATCAGCAGAGTGGAGG<br>CTGAGGATGTTGGGGTTTATTACTGCATGCAAGCTCTACAATGAAACTG<br>CCATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGAACTGCCATTCGGAACCTGATGGCGCGAGG<br>GAGGC |
| hsIGK_0041_V016_J002_IGKV2-<br>29-<br>FP_IGKJ2 | GCCTTGCCAGCCCGCTCAGTTGGACTGTTCGGAACAGTGCGGATATTGT SEQ ID NO:<br>GATGACCCAGACTCCACTCTCTCTGTCCGTCACCCCTGGACAGCCGGCC 6107<br>TCCATCTCCTGCAAGTCTAGTCAGAGCCTCCTGCATAGTGATGGAAAGA<br>CCTATTTGTATTGGTACCTGCAGAAGCCAGGCCAGTCTCCACAGCTCCT<br>GATCTATGAAGTTTCCAGCCGGTTCTCTGGAGTGCCAGATAGGTTCAGT<br>GGCAGCGGGTCAGGGACAGATTTCACACTGAAAATCAGCCGGGTGGAGG<br>CTGAGGATGTTGGGGTTTATTACTGAATGCAAGGTATACACTGATTGGA<br>CTGTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTTGGACTGTTCGGAACCTGATGGCGCGAGG<br>GAGGC |
| hsIGK_0042_V017_J002_IGKV2-<br>30-<br>F_IGKJ2 | GCCTTGCCAGCCCGCTCAGGTAGACACTTCGGAACAGTGGGGATGTTGT SEQ ID NO:<br>GATGACTCAGTCTCCACTCTCCCTGCCCGTCACCCTTGGACAGCCGGCC 6108<br>TCCATCTCCTGCAGGTCTAGTCAAAGCCTCGTATACAGTGATGGAAACA<br>CCTACTTGAATTGGTTTCAGCAGAGGCCAGGCCAATCTCCAAGGCGCCT<br>AATTTATAAGGTTTCTAACCGGGACTCTGGGGTCCCAGACAGATTCAGC<br>GGCAGTGGGTCAGGCACTGATTTCACACTGAAAATCAGCAGGGTGGAGG<br>CTGAGGATGTTGGGGTTTATTACTGCATGCAAGGTACACACTGAGTAGA<br>CACTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGTAGACACTTCGGAACCTGATGGCGCGAGG<br>GAGGC |
| hsIGK_0043_V018_J002_IGKV2-<br>40-<br>F_IGKJ2 | GCCTTGCCAGCCCGCTCAGCACTGTACTTCGGAACGAGGATATTGTGAT SEQ ID NO:<br>GACCCAGACTCCACTCTCCCTGCCCGTCACCCCTGGAGAGCCGGCCTCC 6109<br>ATCTCCTGCAGGTCTAGTCAGAGCCTCTTGGATAGTGATGATGGAAACA<br>CCTATTTGGACTGGTACCTGCAGAAGCCAGGGCAGTCTCCACAGCTCCT<br>GATCTATACGCTTTCCTATCGGGCCTCTGGAGTCCCAGACAGGTTCAGT<br>GGCAGTGGGTCAGGCACTGATTTCACACTGAAAATCAGCAGGGTGGAGG<br>CTGAGGATGTTGGAGTTTATTACTGCATGCAACGTATAGAGTGACACTG<br>TACTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGCACTGTACTTCGGAACCTGATGGCGCGAGG<br>GAGGC |
| hsIGK_0044_V019_J002_IGKV3-<br>07-<br>F_IGKJ2 | GCCTTGCCAGCCCGCTCAGGATGATCCTTCGGAACATCTCAGATACCAC SEQ ID NO:<br>CGGAGAAATTGTAATGACACAGTCTCCAGCCACCCTGTCTTTGTCTCCA 6110<br>GGGGAAAGAGCCACCCTCTCCTGCAGGGCCAGTCAGAGTGTTAGCAGCA<br>GCTACTTATCCTGGTACCAGCAGAAACCTGGGCAGGCTCCCAGGCTCCT<br>CATCTATGGTGCATCCACCAGGGCCACTGGCATCCCAGCCAGGTTCAGT<br>GGCAGTGGGTCTGGGACAGACTTCACTCTCACCATCAGCAGCCTGCAGC<br>CTGAAGATTTTGCAGTTTATTACTGTCAGCAGGATTATAACTGAGATGA<br>TCCTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGGATGATCCTTCGGAACCTGATGGCGCGAGG<br>GAGGC |

| INFORMAL SEQUENCE LISTING | |
|---|---|
| hsIGK_0045_V020_J002_IGKV3-<br>11-<br>F_IGKJ2 | GCCTTGCCAGCCCGCTCAGCGCCAATATTCGGAACCCAATTTCAGATAC SEQ ID NO:<br>CACCGGAGAAATTGTGTTGACACAGTCTCCAGCCACCCTGTCTTTGTCT 6111<br>CCAGGGGAAAGAGCCACCCTCTCCTGCAGGGCCAGTCAGAGTGTTAGCA<br>GCTACTTAGCCTGGTACCAACAGAAACCTGGCCAGGCTCCCAGGCTCCT<br>CATCTATGATGCATCCAACAGGGCCACTGGCATCCCAGCCAGGTTCAGT<br>GGCAGTGGGTCTGGGACAGACTTCACTCTCACCATCAGCAGCCTAGAGC<br>CTGAAGATTTTGCAGTTTATTACTGTCAGCAGCGTAGCAACTGACGCCA<br>ATATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGCGCCAATATTCGGAACCTGATGGCGCGAGG<br>GAGGC |
| hsIGK_0046_V021_J002_IGKV3-<br>15-<br>F_IGKJ2 | GCCTTGCCAGCCCGCTCAGTCAAGCCTTTCGGAACCCAATTTCAGATAC SEQ ID NO:<br>CACTGGAGAAATAGTGATGACGCAGTCTCCAGCCACCCTGTCTGTGTCT 6112<br>CCAGGGGAAAGAGCCACCCTCTCCTGCAGGGCCAGTCAGAGTGTTAGCA<br>GCAACTTAGCCTGGTACCAGCAGAAACCTGGCCAGGCTCCCAGGCTCCT<br>CATCTATGGTGCATCCACCAGGGCCACTGGTATCCCAGCCAGGTTCAGT<br>GGCAGTGGGTCTGGGACAGAGTTCACTCTCACCATCAGCAGCCTGCAGT<br>CTGAAGATTTTGCAGTTTATTACTGTCAGCAGTATAATAACTGATCAAG<br>CCTTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTCAAGCCTTTCGGAACCTGATGGCGCGAGG<br>GAGGC |
| hsIGK_0047_V022_J002_IGKV3-<br>20-<br>F_IGKJ2 | GCCTTGCCAGCCCGCTCAGACGTGTGTTTCGGAACATCTCAGATACCAC SEQ ID NO:<br>CGGAGAAATTGTGTTGACGCAGTCTCCAGGCACCCTGTCTTTGTCTCCA 6113<br>GGGGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTCCT<br>CATCTATGGTGCATCCAGCAGGGCCACTGGCATCCCAGACAGGTTCAGT<br>GGCAGTGGGTCTGGGACAGACTTCACTCTCACCATCAGCAGACTGGAGC<br>CTGAAGATTTTGCAGTGTATTACTGTCAGCAGTATGGTAGCTGAACGTG<br>TGTTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGACGTGTGTTTCGGAACCTGATGGCGCGAGG<br>GAGGC |
| hsIGK_0048_V023_J002_IGKV3-<br>NL4-<br>FNG_IGKJ2 | GCCTTGCCAGCCCGCTCAGTCCGTCTATTCGGAACCCAATTTCAGATAC SEQ ID NO:<br>CACCGGAGAAATTGTGTTGACACAGTCTCCAGCCACCCTGTCTTTGTCT 6114<br>CCAGGGGAAAGAGCCACCCTCTCCTGCAGGGCCAGTCAGGGTGTTAGCA<br>GCTACTTAGCCTGGTACCAGCAGAAACCTGGCCAGGCTCCCAGGCTCCT<br>CATCTATGATGCATCCAACAGGGCCACTGGCATCCCAGCCAGGTTCAGT<br>GGCAGTGGGCCTGGGACAGACTTCACTCTCACCATCAGCAGCCTAGAGC<br>CTGAAGATTTTGCAGTTTATTACTGTCAGCAGCGTAGCAACTGATCCGT<br>CTATTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTCCGTCTATTCGGAACCTGATGGCGCGAGG<br>GAGGC |
| hsIGK_0049_V024_J002_IGKV4-<br>01-<br>F_IGKJ2 | GCCTTGCCAGCCCGCTCAGAAGAGCTGTTCGGAACGGGGACATCGTGAT SEQ ID NO:<br>GACCCAGTCTCCAGACTCCCTGGCTGTGTCTCTGGGCGAGAGGGCCACC 6115<br>ATCAACTGCAAGTCCAGCCAGAGTGTTTTATACAGCTCCAACAATAAGA<br>ACTACTTAGCTTGGTACCAGCAGAAACCAGGACAGCCTCCTAAGCTGCT<br>CATTTACTGGGCATCTACCCGGGAATCGGGGTCCCTGACCGATTCAGT<br>GGCAGCGGGTCTGGGACAGATTTCACTCTCACCATCAGCAGCCTGCAGG<br>CTGAAGATGTGGCAGTTTATTACTGTCAGCAATATTATAGTTGAAAGAG<br>CTGTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGAAGAGCTGTTCGGAACCTGATGGCGCGAGG<br>GAGGC |
| hsIGK_0050_V025_J002_IGKV5-<br>02-<br>F_IGKJ2 | GCCTTGCCAGCCCGCTCAGTATCGCTCTTCGGAACCCATAATCAGATAC SEQ ID NO:<br>CAGGGCAGAAACGACACTCACGCAGTCTCCAGCATTCATGTCAGCGACT 6116<br>CCAGGAGACAAAGTCAACATCTCCTGCAAAGCCAGCCAAGACATTGATG<br>ATGATATGAACTGGTACCAACAGAAACCAGGAGAAGCTGCTATTTTCAT<br>TATTCAAGAAGCTACTACTCTCGTTCCTGGAATCCCACCTCGATTCAGT<br>GGCAGCGGGTATGGAACAGATTTTACCCTCACAATTAATAACATAGAAT<br>CTGAGGATGCTGCATATTACTTCTGTCTACAACATGATAATTGATATCG<br>CTCTTCGGAACGTCGACACTTTTGGCCAGGGGACCAAGCTGGAGATCAA<br>ACGTAAGTACTTTTTTCCACTGATTCTTCACTGTTGCTAATTAGTTTAC<br>TTTGTGTTCCTTTGTGTGGTATCGCTCTTCGGAACCTGATGGCGCGAGG<br>GAGGC |
| hsIGK_0051_V001_J003_IGKV1-<br>05-<br>F_IGKJ3 | GCCTTGCCAGCCCGCTCAGGTTCCGAAAAGTAACGCCAATCTCAGGTGC SEQ ID NO:<br>CAAATGTGACATCCAGATGACCCAGTCTCCTTCCACCCTGTCTGCATCT 6117<br>GTAGGAGACAGAGTCACCATCACTTGCCGGGCCAGTCAGAGTATTAGTA<br>GCTGGTTAGCCTGGTATCAGCAGAAACCAGGGAAAGCCCCTAAGCTCCT<br>GATCTATAAGGCGTCTAGTTTAGAAAGTGGGGTCCCATCAAGGTTCAGC |

| INFORMAL SEQUENCE LISTING | |
|---|---|
| | GGCAGTGGATCTGGGACAGAATTCACTCTCACCATCAGCAGCCTGCAGC<br>CTGATGATTTTGCAACTTATTACTGCCAACAGTATAATAGTTGAGTTCC<br>GAAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGTTCCGAAAAGTAACGCTGATGGCGCGAGG<br>GAGGC |
| hsIGK_0052_V002_J003_IGKV1-<br>06-<br>F_IGKJ3 | GCCTTGCCAGCCCGCTCAGCGTTACTTAAGTAACGCCAATCTCAGGTGC SEQ ID NO:<br>CAGATGTGCCATCCAGATGACCCAGTCTCCATCCTCCCTGTCTGCATCT 6118<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCTCCT<br>GATCTATGCTGCATCCAGTTTACAAAGTGGGGTCCCCATCAAGGTTCAGC<br>GGCAGTGGATCTGGCACAGATTTCACTCTCACCATCAGCAGCCTGCAGC<br>CTGAAGATTTTGCAACTTATTACTGTCTACAAGATTACAATTGACGTTA<br>CTTAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGCGTTACTTAAGTAACGCTGATGGCGCGAGG<br>GAGGC |
| hsIGK_0053_V003_J003_IGKV1-<br>08-<br>F_IGKJ3 | GCCTTGCCAGCCCGCTCAGTAGGAGACAAGTAACGCCAATCTCAGGTGC SEQ ID NO:<br>CAGATGTGCCATCCGGATGACCCAGTCTCCATCCTCATTCTCTGCATCT 6119<br>ACAGGAGACAGAGTCACCATCACTTGTCGGGCGAGTCAGGGTATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGATTTCACTCTCACCATCAGCTGCCTGCAGT<br>CTGAAGATTTTGCAACTTATTACTGTCAACAGTATTATAGTTGATAGGA<br>GACAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGTAGGAGACAAGTAACGCTGATGGCGCGAGG<br>GAGGC |
| hsIGK_0054_V004_J003_IGKV1-<br>09-<br>F_IGKJ3 | GCCTTGCCAGCCCGCTCAGGTGTCTACAAGTAACGCCAATCTCAGGTGC SEQ ID NO:<br>CAGATGTGACATCCAGTTGACCCAGTCTCCATCCTTCCTGTCTGCATCT 6120<br>GTAGGAGACAGAGTCACCATCACTTGCCGGGCCAGTCAGGGCATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCAACAGCTTAATAGTTGAGTGTC<br>TACAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGTGTCTACAAGTAACGCTGATGGCGCGAGG<br>GAGGC |
| hsIGK_0055_V005_J003_IGKV1-<br>12-<br>F_IGKJ3 | GCCTTGCCAGCCCGCTCAGGTACAGTGAAGTAACGCCAATCTCAGGTTC SEQ ID NO:<br>CAGATGCGACATCCAGATGACCCAGTCTCCATCTTCCGTGTCTGCATCT 6121<br>GTAGGAGACAGAGTCACCATCACTTGTCGGGCGAGTCAGGGTATTAGCA<br>GCTGGTTAGCCTGGTATCAGCAGAAACCAGGGAAAGCCCCTAAGCTCCT<br>GATCTATGCTGCATCCAGTTTGCAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTACTATTGTCAACAGGCTAACAGTTGAGTACA<br>GTGAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGTACAGTGAAGTAACGCTGATGGCGCGAGG<br>GAGGC |
| hsIGK_0056_V006_J003_IGKV1-<br>13-<br>FP_IGKJ3 | GCCTTGCCAGCCCGCTCAGGGATCATCAAGTAACGCCAATCTCAGGTGC SEQ ID NO:<br>CAGATGTGCCATCCAGTTGACCCAGTCTCCATCCTCCCTGTCTGCATCT 6122<br>GTAGGAGACAGAGTCACCATCACTTGCCGGGCAAGTCAGGGCATTAGCA<br>GTGCTTTAGCCTGGTATATCAGCAGAAACCAGGGAAAGCTCCTAAGCTCCT<br>GATCTATGATGCCTCCAGTTTGGAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTATTACTGTCAACAGTTTAATAATTGAGGATC<br>ATCAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGGATCATCAAGTAACGCTGATGGCGCGAGG<br>GAGGC |
| hsIGK_0057_V007_J003_IGKV1-<br>16-<br>F_IGKJ3 | GCCTTGCCAGCCCGCTCAGTATTGGCGAAGTAACGCCAATCTCAGGTGC SEQ ID NO:<br>CAGATGTGACATCCAGATGACCCAGTCTCCATCTCACTGTCTGCATCT 6123<br>GTAGGAGACAGAGTCACCATCACTTGTCGGGCGAGTCAGGGCATTAGCA<br>ATTATTTAGCCTGGTTTCAGCAGAAACCAGGGAAAGCCCCTAAGTCCCT<br>GATCTATGCTGCATCCAGTTTGCAAAGTGGGGTCCCATCAAAGTTCAGC<br>GGCAGTGGATCTGGGACAGATTTCACTCTCACCATCAGCAGCCTGCAGC<br>CTGAAGATTTTGCAACTTATTACTGCCAACAGTATAATAGTTGATATTG<br>GCGAAGTAACGGTCGACCTTTCGGCCCTGGGACCAAAGTGGATATCAAA |

| | INFORMAL SEQUENCE LISTING | |
|---|---|---|
| | CGTAAGTACATCTGTCTCAATTATTCGTGAGATTTTAGTGCCATTGTAT<br>CATTTGTGCAAGTTTTGTGTATTGGCGAAGTAACGCTGATGGCGCGAGG<br>GAGGC | |
| hsIGK_0058_V008_J003_IGKV1-<br>17-<br>F_IGKJ3 | GCCTTGCCAGCCCGCTCAGAGGCTTGAAAGTAACGCCAATCTCAGGTGC<br>CAGGTGTGACATCCAGATGACCCAGTCTCCATCCTCCCTGTCTGCATCT<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCGCCT<br>GATCTATGCTGCATCCAGTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCTACAGCATAATAGTTGAAGGCT<br>TGAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGAGGCTTGAAAGTAACGCTGATGGCGCGAGG<br>GAGGC | SEQ ID NO:<br>6124 |
| hsIGK_0059_V009_J003_IGKV1-<br>27-<br>F_IGKJ3 | GCCTTGCCAGCCCGCTCAGACACACGTAAGTAACGCTAATATCAGATAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTATTTAGCCTGGTATCAGCAGAAACCAGGGAAAGTTCCTAAGCTCCT<br>GATCTATGCTGCATCCACTTTGCAATCAGGGGTCCCATCTCGGTTCAGT<br>GGCAGTGGATCTGGGACAGATTTCACTCTCACCATCAGCAGCCTGCAGC<br>CTGAAGATGTTGCAACTTATTACTGTCAAAGTATAACAGTTGAACACA<br>CGTAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGACACACGTAAGTAACGCTGATGGCGCGAGG<br>GAGGC | SEQ ID NO:<br>6125 |
| hsIGK_0060_V010_J003_IGKV1-<br>33-<br>F_IGKJ3 | GCCTTGCCAGCCCGCTCAGTAGACGGAAAGTAACGCTAATCGCAGGTGC<br>CAGATGTGACATCCAGATGACCCAGTCTCCATCCTCCCTGTCTGCATCT<br>GTAGGAGACAGAGTCACCATCACTTGCCAGGCGAGTCAGGACATTAGCA<br>ACTATTTAAATTGGTATCAGCAGAAACCAGGGAAAGCCCCTAAGCTCCT<br>GATCTACGATGCATCCAATTTGGAAACAGGGGTCCCATCAAGGTTCAGT<br>GGAAGTGGATCTGGGACAGATTTTACTTTCACCATCAGCAGCCTGCAGC<br>CTGAAGATATTGCAACATATTACTGTCAACAGTATGATAATTGATAGAC<br>GGAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGTAGACGGAAAGTAACGCTGATGGCGCGAGG<br>GAGGC | SEQ ID NO:<br>6126 |
| hsIGK_0061_V011_J003_IGKV1-37-<br>O_IGKJ3 | GCCTTGCCAGCCCGCTCAGCAGCTCTTAAGTAACGCCAATCTCAGGTGC<br>CAGATGTGACATCCAGTTGACCCAGTCTCCATCCTCCCTGTCTGCATCT<br>GTAGGAGACAGAGTCACCATCACTTGCCGGGTGAGTCAGGGCATTAGCA<br>GTTATTTAAATTGGTATCGGCAGAAACCAGGGAAAGTTCCTAAGCTCCT<br>GATCTATAGTGCATCCAATTTGCAATCTGGAGTCCCATCTCGGTTCAGT<br>GGCAGTGGATCTGGGACAGATTTCACTCTCACTATCAGCAGCCTGCAGC<br>CTGAAGATGTTGCAACTTATTACGGTCAACGGACTTACAATTGACAGCT<br>CTTAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGCAGCTCTTAAGTAACGCTGATGGCGCGAGG<br>GAGGC | SEQ ID NO:<br>6127 |
| hsIGK_0062_V012_J003_IGKV1-39-<br>FP_IGKJ3 | GCCTTGCCAGCCCGCTCAGGAGCGATAAAGTAACGCCAATCTCAGGTGC<br>CAGATGTGACATCCAGATGACCCAGTCTCCATCCTCCCTGTCTGCATCT<br>GTAGGAGACAGAGTCACCATCACTTGCCGGGCAAGTCAGAGCATTAGCA<br>GCTATTTAAATTGGTATCAGCAGAAACCAGGGAAAGCCCCTAAGCTCCT<br>GATCTATGCTGCATCCAGTTTGCAAAGTGGGGTCCCATCAAGGTTCAGT<br>GGCAGTGGATCTGGGACAGATTTCACTCTCACCATCAGCAGTCTGCAAC<br>CTGAAGATTTTGCAACTTACTACTGTCAACAGAGTTACAGTTGAGAGCG<br>ATAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGAGCGATAAAGTAACGCTGATGGCGCGAGG<br>GAGGC | SEQ ID NO:<br>6128 |
| hsIGK_0063_V013_J003_IGKV1-<br>NL1-<br>F_IGKJ3 | GCCTTGCCAGCCCGCTCAGGCATCTGAAAGTAACGCCAATCTCAGGTAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTCTTTAGCCTGGTATCAGCAGAAACCAGGGAAAGCCCCTAAGCTCCT<br>GCTCTATGCTGCATCCAGATTGGAAAGTGGGGTCCCATCCAGGTTCAGT<br>GGCAGTGGATCTGGGACGGATTACACTCTCACCATCAGCAGCCTGCAGC<br>CTGAAGATTTTGCAACTTATTACTGTCAACAGTATTATAGTTGAGCATC<br>TGAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGGCATCTGAAAGTAACGCTGATGGCGCGAGG<br>GAGGC | SEQ ID NO:<br>6129 |

| INFORMAL SEQUENCE LISTING | | |
|---|---|---|
| hsIGK_0064_V014_J003_IGKV2-24-F_IGKJ3 | GCCTTGCCAGCCCGCTCAGTGCTACACAAGTAACGAGTGGGGATATTGT GATGACCCAGACTCCACTCTCCTCACCTGTCACCCTTGGACAGCCGGCC TCCATCTCCTGCAGGTCTAGTCAAAGCCTCGTACACAGTGATGGAAACA CCTACTTGAGTTGGCTTCAGCAGAGGCCAGGCCAGCCTCCAAGACTCCT AATTTATAAGATTTCTAACCGGTTCTCTGGGGTCCCAGACAGATTCAGT GGCAGTGGGGCAGGGACAGATTTCACACTGAAAATCAGCAGGGTGGAAG CTGAGGATGTCGGGGTTTATTACTGCATGCAAGCTACACAATGATGCTA CACAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGTGCTACACAAGTAACGCTGATGGCGCGAGG GAGGC | SEQ ID NO: 6130 |
| hsIGK_0065_V015_J003_IGKV2-28-F_IGKJ3 | GCCTTGCCAGCCCGCTCAGAACTGCCAAAGTAACGAGTGGGGATATTGT GATGACTCAGTCTCCACTCTCCCTGCCCGTCACCCCTGGAGAGCCGGCC TCCATCTCCTGCAGGTCTAGTCAGAGCCTCCTGCATAGTAATGGATACA ACTATTTGGATTGGTACCTGCAGAAGCCAGGGCAGTCTCCACAGCTCCT GATCTATTTGGGTTCTAATCGGGCCTCCGGGGTCCCTGACAGGTTCAGT GGCAGTGGATCAGGCACAGATTTTACACTGAAAATCAGCAGAGTGGAGG CTGAGGATGTTGGGGTTTATTACTGCATGCAAGCTCTACAATGAAACTG CCAAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGAACTGCCAAAGTAACGCTGATGGCGCGAGG GAGGC | SEQ ID NO: 6131 |
| hsIGK_0066_V016_J003_IGKV2-29-FP_IGKJ3 | GCCTTGCCAGCCCGCTCAGTTGGACTGAAGTAACGAGTGCGGATATTGT GATGACCCAGACTCCACTCTCTCTGTCCGTCACCCCTGGACAGCCGGCC TCCATCTCCTGCAAGTCTAGTCAGAGCCTCCTGCATAGTGATGGAAAGA CCTATTTGTATTGGTACCTGCAGAAGCCAGGCCAGTCTCCACAGCTCCT GATCTATGAAGTTTCCAGCCGGTTCTCTGGAGTGCCAGATAGGTTCAGT GGCAGCGGGTCAGGGACAGATTTCACACTGAAAATCAGCCGGGTGGAGG CTGAGGATGTTGGGGTTTATTACTGTAATGCAAGGTATACACTGATTGGA CTGAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGTTGGACTGAAGTAACGCTGATGGCGCGAGG GAGGC | SEQ ID NO: 6132 |
| hsIGK_0067_V017_J003_IGKV2-30-F_IGKJ3 | GCCTTGCCAGCCCGCTCAGGTAGACACAAGTAACGAGTGGGGATGTTGT GATGACTCAGTCTCCACTCTCCCTGCCCGTCACCCTTGGACAGCCGGCC TCCATCTCCTGCAGGTCTAGTCAAAGCCTCGTATACAGTGATGGAAACA CCTACTTGAATTGGTTTCAGCAGAGGCCAGGCCAATCTCCAAGGCGCCT AATTTATAAGGTTTCTAACCGGGACTCTGGGGTCCCAGACAGATTCAGC GGCAGTGGGTCAGGCACTGATTTCACACTGAAAATCAGCAGGGTGGAGG CTGAGGATGTTGGGGTTATTACTGCATGCAAGGTACACACTGAGTAGA CACAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGGTAGACACAAGTAACGCTGATGGCGCGAGG GAGGC | SEQ ID NO: 6133 |
| hsIGK_0068_V018_J003_IGKV2-40-F_IGKJ3 | GCCTTGCCAGCCCGCTCAGCACTGTACAAGTAACGGAGGATATTGTGAT GACCCAGACTCCACTCTCCCTGCCCGTCACCCCTGGAGAGCCGGCCTCC ATCTCCTGCAGGTCTAGTCAGAGCCTCTTGGATAGTGATGATGGAAACA CCTATTTGGACTGGTACCTGCAGAAGCCAGGGCAGTCTCCACAGCTCCT GATCTATACGCTTTCCTATCGGGCCTCTGGAGTCCCAGACAGGTTCAGT GGCAGTGGGTCAGGCACTGATTTCACACTGAAAATCAGCAGGGTGGAGG CTGAGGATGTTGGAGTTTATTACTGCATGCAACGTATAGAGTGACACTG TACAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGCACTGTACAAGTAACGCTGATGGCGCGAGG GAGGC | SEQ ID NO: 6134 |
| hsIGK_0069_V019_J003_IGKV3-07-F_IGKJ3 | GCCTTGCCAGCCCGCTCAGGATGATCCAAGTAACGATCTCAGATACCAC CGGAGAAATTGTAATGACACAGTCTCCAGCCACCCTGTCTTTGTCTCCA GGGGAAAGAGCCACCCTCTCCTGCAGGGCCAGTCAGAGTGTTAGCAGCA GCTACTTATCCTGGTACCAGCAGAAACCTGGGCAGGCTCCCAGGCTCCT CATCTATGGTGCATCCACCAGGGCCACTGGCATCCCAGCCAGGTTCAGT GGCAGTGGGTCTGGGACAGACTTCACTCTCACCATCAGCAGCCTGCAGC CTGAAGATTTTGCAGTTTATTACTGTCAGCAGGATTATAACTGAGATGA TCCAAGTAACGGTCGACCTTTCGGCCCTGGGACCAAAGTGGATATCAAA CGTAAGTACATCTGTCTCAATTATTCGTGAGATTTTAGTGCCATTGTAT CATTTGTGCAAGTTTTGTGGATGATCCAAGTAACGCTGATGGCGCGAGG GAGGC | SEQ ID NO: 6135 |
| hsIGK_0070_V020_J003_IGKV3-11-F_IGKJ3 | GCCTTGCCAGCCCGCTCAGCGCCAATAAAGTAACGCCAATTTCAGATAC CACCGGAGAAATTGTGTTGACACAGTCTCCAGCCACCCTGTCTTTGTCT CCAGGGGAAAGAGCCACCCTCTCCTGCAGGGCCAGTCAGAGTGTTAGCA GCTACTTAGCCTGGTACCAACAGAAACCTGGCCAGGCTCCCAGGCTCCT | SEQ ID NO: 6136 |

| | INFORMAL SEQUENCE LISTING | |
|---|---|---|
| | CATCTATGATGCATCCAACAGGGCCACTGGCATCCCAGCCAGGTTCAGT<br>GGCAGTGGGTCTGGGACAGACTTCACTCTCACCATCAGCAGCCTAGAGC<br>CTGAAGATTTTGCAGTTTATTACTGTCAGCAGCGTAGCAACTGACGCCA<br>ATAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGCGCCAATAAAGTAACGCTGATGGCGCGAGG<br>GAGGC | |
| hsIGK_0071_V021_J003_IGKV3-15-<br>F_IGKJ3 | GCCTTGCCAGCCCGCTCAGTCAAGCCTAAGTAACGCCAATTTCAGATAC<br>CACTGGAGAAATAGTGATGACGCAGTCTCCAGCCACCCTGTCTGTGTCT<br>CCAGGGGAAAGAGCCACCCTCTCCTGCAGGGCCAGTCAGAGTGTTAGCA<br>GCAACTTAGCCTGGTACCAGCAGAAACCTGGCCAGGCTCCCAGGCTCCT<br>CATCTATGGTGCATCCACCAGGGCCACTGGTATCCCAGCCAGGTTCAGT<br>GGCAGTGGGTCTGGGACAGAGTTCACTCTCACCATCAGCAGCCTGCAGT<br>CTGAAGATTTTGCAGTTTATTACTGTCAGCAGTATAATAACTGATCAAG<br>CCTAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGTCAAGCCTAAGTAACGCTGATGGCGCGAGG<br>GAGGC | SEQ ID NO:<br>6137 |
| hsIGK_0072_V022_J003_IGKV3-20-<br>F_IGKJ3 | GCCTTGCCAGCCCGCTCAGACGTGTGTAAGTAACGATCTCAGATACCAC<br>CGGAGAAATTGTGTTGACGCAGTCTCCAGGCACCCTGTCTTTGTCTCCA<br>GGGGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTCCT<br>CATCTATGGTGCATCCAGCAGGGCCACTGGCATCCCAGACAGGTTCAGT<br>GGCAGTGGGTCTGGGACAGACTTCACTCTCACCATCAGCAGACTGGAGC<br>CTGAAGATTTTGCAGTGTATTACTGTCAGCAGTATGGTAGCTGAACGTG<br>TGTAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGACGTGTGTAAGTAACGCTGATGGCGCGAGG<br>GAGGC | SEQ ID NO:<br>6138 |
| hsIGK_0073_V023_J003_IGKV3-<br>NL4-<br>FNG_IGKJ3 | GCCTTGCCAGCCCGCTCAGTCCGTCTAAAGTAACGCCAATTTCAGATAC<br>CACCGGAGAAATTGTGTTGACACAGTCTCCAGCCACCCTGTCTTTGTCT<br>CCAGGGGAAAGAGCCACCCTCTCCTGCAGGGCCAGTCAGGGTGTTAGCA<br>GCTACTTAGCCTGGTACCAGCAGAAACCTGGCCAGGCTCCCAGGCTCCT<br>CATCTATGATGCATCCAACAGGGCCACTGGCATCCCAGCCAGGTTCAGT<br>GGCAGTGGGCCTGGGACAGACTTCACTCTCACCATCAGCAGCCTAGAGC<br>CTGAAGATTTTGCAGTTTATTACTGTCAGCAGCGTAGCAACTGATCCGT<br>CTAAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGTCCGTCTAAAGTAACGCTGATGGCGCGAGG<br>GAGGC | SEQ ID NO:<br>6139 |
| hsIGK_0074_V024_J003_IGKV4-01-<br>F_IGKJ3 | GCCTTGCCAGCCCGCTCAGAAGAGCTGAAGTAACGGGGACATCGTGAT<br>GACCCAGTCTCCAGACTCCCTGGCTGTGTCTCTGGGCGAGAGGGCCACC<br>ATCAACTGCAAGTCCAGCCAGAGTGTTTTATACAGCTCCAACAATAAGA<br>ACTACTTAGCTTGGTACCAGCAGAAACCAGGACAGCCTCCTAAGCTGCT<br>CATTTACTGGGCATCTACCCGGGAATCCGGGGTCCCTGACCGATTCAGT<br>GGCAGCGGGTCTGGGACAGATTTCACTCTCACCATCAGCAGCCTGCAGG<br>CTGAAGATGTGGCAGTTTATTACTGTCAGCAATATTATAGTTGAAAGAG<br>CTGAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGAAGAGCTGAAGTAACGCTGATGGCGCGAGG<br>GAGGC | SEQ ID NO:<br>6140 |
| hsIGK_0075_V025_J003_IGKV5-02-<br>F_IGKJ3 | GCCTTGCCAGCCCGCTCAGTATCGCTCAAGTAACGCCATAATCAGATAC<br>CAGGGCAGAAACGACACTCACGCAGTCTCCAGCATTCATGTCAGCGACT<br>CCAGGAGACAAAGTCAACATCTCCTGCAAAGCCAGCCAAGACATTGATG<br>ATGATATGAACTGGTACCAACAGAAACCAGGAGAAGCTGCTATTTTCAT<br>TATTCAAGAAGCTACTACTCTCGTTCCTGGAATCCCACCTCGATTCAGT<br>GGCAGCGGGTATGGAACAGATTTTACCCTCACAATTAATAACATAGAAT<br>CTGAGGATGCTGCATATTACTTCTGTCTACAACATGATAATTGATATCG<br>CTCAAGTAACGGTCGACCTTTCGGCCCTGGGACCAAAGTGGATATCAAA<br>CGTAAGTACATCTGTCTCAATTATTCGTGAGATTTTAGTGCCATTGTAT<br>CATTTGTGCAAGTTTTGTGTATCGCTCAAGTAACGCTGATGGCGCGAGG<br>GAGGC | SEQ ID NO:<br>6141 |
| hsIGK_0076_V001_J004_IGKV1-05-<br>F_IGKJ4 | GCCTTGCCAGCCCGCTCAGGTTCCGAAGTCTCCTACCAATCTCAGGTGC<br>CAAATGTGACATCCAGATGACCCAGTCTCCTTCCACCCTGTCTGCATCT<br>GTAGGAGACAGAGTCACCATCACTTGCCGGGCCAGTCAGAGTATTAGTA<br>GCTGGTTGGCCTGGTATCAGCAGAAACCAGGGAAAGCCCCTAAGCTCCT<br>GATCTATAAGGCGTCTAGTTTAGAAAGTGGGGTCCCATCAAGGTTCAGC<br>GGCAGTGGATCTGGGACAGAATTCACTCTCACCATCAGCAGCCTGCAGC<br>CTGATGATTTTGCAACTTATTACTGCCAACAGTATAATAGTTGAGTTCC<br>GAAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA | SEQ ID NO:<br>6142 |

| INFORMAL SEQUENCE LISTING | | |
|---|---|---|
| | GCGTTTTTGTGTTTGAGATGTTCCGAAGTCTCCTACTGATGGCGCGAGG<br>GAGGC | |
| hsIGK_0077_V002_J004_IGKV1-06-<br>F_IGKJ4 | GCCTTGCCAGCCCGCTCAGCGTTACTTGTCTCCTACCAATCTCAGGTGC<br>CAGATGTGCCATCCAGATGACCCAGTCTCCATCCTCCCTGTCTGCATCT<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCTCCT<br>GATCTATGCTGCATCCAGTTTACAAAGTGGGGTCCCATCAAGGTTCAGC<br>GGCAGTGGATCTGGCACAGATTTCACTCTCACCATCAGCAGCCTGCAGC<br>CTGAAGATTTTGCAACTTATTACTGTCTACAAGATTACAATTGACGTTA<br>CTTGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATCGTTACTTGTCTCCTACTGATGGCGCGAGG<br>GAGGC | SEQ ID NO:<br>6143 |
| hsIGK_0078_V003_J004_IGKV1-08-<br>F_IGKJ4 | GCCTTGCCAGCCCGCTCAGTAGGAGACGTCTCCTACCAATCTCAGGTGC<br>CAGATGTGCCATCCGGATGACCCAGTCTCCATCCTCATTCTCTGCATCT<br>ACAGGAGACAGAGTCACCATCACTTGTCGGGCGAGTCAGGGTATTAGCA<br>GTTATTTAGCCTGGTATCAGCAAAAACCAGGGAAAGCCCCTAAGCTCCT<br>GATCTATGCTGCACTTTGCAAAGTGGGGTCCCATCAAGGTTCAGC<br>GGCAGTGGATCTGGGACAGATTTCACTCTCACCATCAGCTGCCTGCAGT<br>CTGAAGATTTTGCAACTTATTACTGTCAACAGTATTATAGTTGATAGGA<br>GACGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTAGGAGACGTCTCCTACTGATGGCGCGAGG<br>GAGGC | SEQ ID NO:<br>6144 |
| hsIGK_0079_V004_J004_IGKV1-09-<br>F_IGKJ4 | GCCTTGCCAGCCCGCTCAGGTGTCTACGTCTCCTACCAATCTCAGGTGC<br>CAGATGTGACATCCAGTTGACCCAGTCTCCATCCTTCCTGTCTGCATCT<br>GTAGGAGACAGAGTCACCATCACTTGCCGGGCCAGTCAGGGCATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCAACAGCTTAATAGTTGAGTGTC<br>TACGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGTGTCTACGTCTCCTACTGATGGCGCGAGG<br>GAGGC | SEQ ID NO:<br>6145 |
| hsIGK_0080_V005_J004_IGKV1-12-<br>F_IGKJ4 | GCCTTGCCAGCCCGCTCAGGTACAGTGGTCTCCTACCAATCTCAGGTTC<br>CAGATGCGACATCCAGATGACCCAGTCTCCATCTTCCGTGTCTGCATCT<br>GTAGGAGACAGAGTCACCATCACTTGTCGGGCGAGTCAGGGTATTAGCA<br>GCTGGTTAGCCTGGTATCAGCAGAAACCAGGGAAAGCCCCTAAGCTCCT<br>GATCTATGCTGCATCCAGTTTGCAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTACTATTGTCAACAGGCTAACAGTTGAGTACA<br>GTGGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGTACAGTGGTCTCCTACTGATGGCGCGAGG<br>GAGGC | SEQ ID NO:<br>6146 |
| hsIGK_0081_V006_J004_IGKV1-13-<br>FP_IGKJ4 | GCCTTGCCAGCCCGCTCAGGGATCATCGTCTCCTACCAATCTCAGGTGC<br>CAGATGTGCCATCCAGTTGACCCAGTCTCCATCCTCCCTGTCTGCATCT<br>GTAGGAGACAGAGTCACCATCACTTGCCGGGCAAGTCAGGGCATTAGCA<br>GTGCTTTAGCCTGATATCAGCAGAAACCAGGGAAAGCTCCTAAGCTCCT<br>GATCTATGATGCCTCCAGTTTGGAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTATTACTGTCAACAGTTTAATAATTGAGGATC<br>ATCGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGGATCATCGTCTCCTACTGATGGCGCGAGG<br>GAGGC | SEQ ID NO:<br>6147 |
| hsIGK_0082_V007_J004_IGKV1-16-<br>F_IGKJ4 | GCCTTGCCAGCCCGCTCAGTATTGGCGGTCTCCTACCAATCTCAGGTGC<br>CAGATGTGACATCCAGATGACCCAGTCTCCATCCTCACTGTCTGCATCT<br>GTAGGAGACAGAGTCACCATCACTTGTCGGGCGAGTCAGGGCATTAGCA<br>ATTATTTAGCCTGGTTTCAGCAGAAACCAGGGAAAGCCCCTAAGTCCCT<br>GATCTATGCTGCATCCAGTTTGCAAAGTGGGGTCCCATCAAAGTTCAGC<br>GGCAGTGGATCTGGGACAGATTTCACTCTCACCATCAGCAGCCTGCAGC<br>CTGAAGATTTTGCAACTTATTACTGCCAACAGTATAATAGTTGATATTG<br>GCGGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTATTGGCGGTCTCCTACTGATGGCGCGAGG<br>GAGGC | SEQ ID NO:<br>6148 |
| hsIGK_0083_V008_J004_IGKV1-17-<br>F_IGKJ4 | GCCTTGCCAGCCCGCTCAGAGGCTTGAGTCTCCTACCAATCTCAGGTGC<br>CAGGTGTGACATCCAGATGACCCAGTCTCCATCCTCCCTGTCTGCATCT | SEQ ID NO:<br>6149 |

-continued

| INFORMAL SEQUENCE LISTING | | |
|---|---|---|
| | GTAGGAGACAGAGTCACCATCACTTGCCGGGCAAGTCAGGGCATTAGAA<br>ATGATTTAGGCTGGTATCAGCAGAAACCAGGGAAAGCCCCTAAGCGCCT<br>GATCTATGCTGCATCCAGTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCTACAGCATAATAGTTGAAGGCT<br>TGAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATAGGCTTGAGTCTCCTACTGATGGCGCGAGG<br>GAGGC | |
| hsIGK_0084_V009_J004_IGKV1-27-<br>F_IGKJ4 | GCCTTGCCAGCCCGCTCAGACACACGTGTCTCCTACTAATATCAGATAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTATTTAGCCTGGTATCAGCAGAAACCAGGGAAAGTTCCTAAGCTCCT<br>GATCTATGCTGCATCCACTTTGCAATCAGGGGTCCCATCTCGGTTCAGT<br>GGCAGTGGATCTGGGACAGATTTCACTCTCACCATCAGCAGCCTGCAGC<br>CTGAAGATGTTGCAACTTATTACTGTCAAAGTATAACAGTTGAACACA<br>CGTGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATACACACGTGTCTCCTACTGATGGCGCGAGG<br>GAGGC | SEQ ID NO:<br>6150 |
| hsIGK_0085_V010_J004_IGKV1-33-<br>F_IGKJ4 | GCCTTGCCAGCCCGCTCAGTAGACGGAGTCTCCTACTAATCGCAGGTGC<br>CAGATGTGACATCCAGATGACCCAGTCTCCATCCTCCCTGTCTGCATCT<br>GTAGGAGACAGAGTCACCATCACTTGCCAGGCGAGTCAGGACATTAGCA<br>ACTATTTAAATTGGTATCAGCAGAAACCAGGGAAAGCCCCTAAGCTCCT<br>GATCTACGATGCATCCAATTTGGAAACAGGGGTCCCATCAAGGTTCAGT<br>GGAAGTGGATCTGGGACAGATTTTACTTTCACCATCAGCAGCCTGCAGC<br>CTGAAGATATTGCAACATATTACTGTCAACAGTATGATAATTGATAGAC<br>GGAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTAGACGGAGTCTCCTACTGATGGCGCGAGG<br>GAGGC | SEQ ID NO:<br>6151 |
| hsIGK_0086_V011_J004_IGKV1-37-<br>O_IGKJ4 | GCCTTGCCAGCCCGCTCAGCAGCTCTTGTCTCCTACCAATCTCAGGTGC<br>CAGATGTGACATCCAGTTGACCCAGTCTCCATCCTCCCTGTCTGCATCT<br>GTAGGAGACAGAGTCACCATCACTTGCCGGGTGAGTCAGGGCATTAGCA<br>GTTATTTAAATTGGTATCGGCAGAAACCAGGGAAAGTTCCTAAGCTCCT<br>GATCTATAGTGCATCCAATTTGCAATCTGGAGTCCCATCTCGGTTCAGT<br>GGCAGTGGATCTGGGACAGATTTCACTCTCACTATCAGCAGCCTGCAGC<br>CTGAAGATGTTGCAACTTATTACGGTCAACGGACTTACAATTGACAGCT<br>CTTGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATCAGCTCTTGTCTCCTACTGATGGCGCGAGG<br>GAGGC | SEQ ID NO:<br>6152 |
| hsIGK_0087_V012_J004_IGKV1-39-<br>FP_IGKJ4 | GCCTTGCCAGCCCGCTCAGGAGCGATAGTCTCCTACCAATCTCAGGTGC<br>CAGATGTGACATCCAGATGACCCAGTCTCCATCCTCCCTGTCTGCATCT<br>GTAGGAGACAGAGTCACCATCACTTGCCGGGCAAGTCAGGAGCATTAGCA<br>GCTATTTAAATTGGTATCAGCAGAAACCAGGGAAAGCCCCTAAGCTCCT<br>GATCTATGCTGCATCCAGTTTGCAAAGTGGGGTCCCATCAAGGTTCAGT<br>GGCAGTGGATCTGGGACAGATTTCACTCTCACCATCAGCAGTCTGCAAC<br>CTGAAGATTTTGCAACTTACTACTGTCAACAGAGTTACAGTTGAGAGCG<br>ATAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGAGCGATAGTCTCCTACTGATGGCGCGAGG<br>GAGGC | SEQ ID NO:<br>6153 |
| hsIGK_0088_V013_J004_IGKV1-<br>NL1-<br>F_IGKJ4 | GCCTTGCCAGCCCGCTCAGGCATCTGAGTCTCCTACCAATCTCAGGTAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTCTTTAGCCTGGTATCAGCAGAAACCAGGGAAAGCCCCTAAGCTCCT<br>GCTCTATGCTGCATCCAGATTGGAAAGTGGGGTCCCATCCAGGTTCAGT<br>GGCAGTGGATCTGGGACGGATTACACTCTCACCATCAGCAGCCTGCAGC<br>CTGAAGATTTTGCAACTTATTACTGTCAACAGTATTATAGTTGAGCATC<br>TGAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGCATCTGAGTCTCCTACTGATGGCGCGAGG<br>GAGGC | SEQ ID NO:<br>6154 |
| hsIGK_0089_V014_J004_IGKV2-<br>24-<br>F_IGKJ4 | GCCTTGCCAGCCCGCTCAGTGCTACACGTCTCCTAAGTGGGGATATTGT<br>GATGACCCAGACTCCACTCTCCTCACCCTGTCACCCTTGGACAGCCGGCC<br>TCCATCTCCTGCAGGTCTAGTCAAAGCCTCGTACACAGTGATGGAAACA<br>CCTACTTGAGTTGGCTTCAGCAGAGGCCAGGCCAGCCTCCAAGACTCCT<br>AATTTATAAGATTTCTAACCGGTTCTCTGGGGTCCCAGACAGATTCAGT<br>GGCAGTGGGGCAGGGACAGATTTCACACTGAAAATCAGCAGGGTGGAAG<br>CTGAGGATGTCGGGGTTTATTACTGCATGCAAGCTACACAATGATGCTA | SEQ ID NO:<br>6155 |

| INFORMAL SEQUENCE LISTING | |
|---|---|
| | CACGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTGCTACACGTCTCCTACTGATGGCGCGAGG<br>GAGGC |
| hsIGK_0090_V015_J004_IGKV2-<br>28-<br>F_IGKJ4 | GCCTTGCCAGCCCGCTCAGAACTGCCAGTCTCCTAAGTGGGGATATTGT SEQ ID NO:<br>GATGACTCAGTCTCCACTCTCCCTGCCCGTCACCCCTGGAGAGCCGGCC 6156<br>TCCATCTCCTGCAGGTCTAGTCAGAGCCTCCTGCATAGTAATGGATACA<br>ACTATTTGGATTGGTACCTGCAGAAGCCAGGGCAGTCTCCACAGCTCCT<br>GATCTATTTGGGTTCTAATCGGGCCTCCGGGGTCCCTGACAGGTTCAGT<br>GGCAGTGGATCAGGCACAGATTTTACACTGAAAATCAGCAGAGTGGAGG<br>CTGAGGATGTTGGGGTTTATTACTGCATGCAAGCTCTACAATGAAACTG<br>CCAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATAACTGCCAGTCTCCTACTGATGGCGCGAGG<br>GAGGC |
| hsIGK_0091_V016_J004_IGKV2-<br>29-<br>FP_IGKJ4 | GCCTTGCCAGCCCGCTCAGTTGGACTGGTCTCCTAAGTGCGGATATTGT SEQ ID NO:<br>GATGACCCAGACTCCACTCTCTCTGTCCGTCACCCCTGGACAGCCGGCC 6157<br>TCCATCTCCTGCAAGTCTAGTCAGAGCCTCCTGCATAGTGATGGAAAGA<br>CCTATTTGTATTGGTACCTGCAGAAGCCAGGCCAGTCTCCACAGCTCCT<br>GATCTATGAAGTTTCCAGCCGGTTCTCTGGAGTGCCAGATAGGTTCAGT<br>GGCAGCGGGTCAGGGACAGATTTCACACTGAAAATCAGCCGGGTGGAGG<br>CTGAGGATGTTGGGGTTTATTACTGAATGCAAGGTATACACTGATTGGA<br>CTGGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTTGGACTGGTCTCCTACTGATGGCGCGAGG<br>GAGGC |
| hsIGK_0092_V017_J004_IGKV2-<br>30-<br>F_IGKJ4 | GCCTTGCCAGCCCGCTCAGGTAGACACGTCTCCTAAGTGGGGATGTTGT SEQ ID NO:<br>GATGACTCAGTCTCCACTCTCCCTGCCCGTCACCCTTGGACAGCCGGCC 6158<br>TCCATCTCCTGCAGGTCTAGTCAAAGCCTCGTATACAGTGATGGAAACA<br>CCTACTTGAATTGGTTTCAGCAGAGGCCAGGCCAATCTCCAAGGCGCCT<br>AATTTATAAGGTTTCTAACCGGGACTCTGGGGTCCCAGACAGATTCAGC<br>GGCAGTGGGTCAGGCACTGATTTCACACTGAAAATCAGCAGGGTGGAGG<br>CTGAGGATGTTGGGGTTTATTACTGCATGCAAGGTACACACTGAGTAGA<br>CACGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGTAGACACGTCTCCTACTGATGGCGCGAGG<br>GAGGC |
| hsIGK_0093_V018_J004_IGKV2-<br>40-<br>F_IGKJ4 | GCCTTGCCAGCCCGCTCAGCACTGTACGTCTCCTAGAGGATATTGTGAT SEQ ID NO:<br>GACCCAGACTCCACTCTCCCTGCCCGTCACCCCTGGAGAGCCGGCCTCC 6159<br>ATCTCCTGCAGGTCTAGTCAGAGCCTCTTGGATAGTGATGATGGAAACA<br>CCTATTTGGACTGGTACCTGCAGAAGCCAGGGCAGTCTCCACAGCTCCT<br>GATCTATACGCTTTCCTATCGGGCCTCTGGAGTCCCAGACAGGTTCAGT<br>GGCAGTGGGTCAGGCACTGATTTCACACTGAAAATCAGCAGGGTGGAGG<br>CTGAGGATGTTGGAGTTTATTACTGCATGCAACGTATAGAGTGACACTG<br>TACGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATCACTGTACGTCTCCTACTGATGGCGCGAGG<br>GAGGC |
| hsIGK_0094_V019_J004_IGKV3-<br>07-<br>F_IGKJ4 | GCCTTGCCAGCCCGCTCAGGATGATCCGTCTCCTAATCTCAGATACCAC SEQ ID NO:<br>CGGAGAAATTGTAATGACACAGTCTCCAGCCACCCTGTCTTTGTCTCCA 6160<br>GGGGAAAGAGCCACCCTCTCCTGCAGGGCCAGTCAGAGTGTTAGCAGCA<br>GCTACTTATCCTGGTACCAGCAGAAACCTGGGCAGGCTCCCAGGCTCCT<br>CATCTATGGTGCATCCACCAGGGCCACTGGCATCCCAGCCAGGTTCAGT<br>GGCAGTGGGTCTGGGACAGACTTCACTCTCACCATCAGCAGCCTGCAGC<br>CTGAAGATTTTGCAGTTTATTACTGTCAGCAGGATTATAACTGAGATGA<br>TCCGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATGATGATCCGTCTCCTACTGATGGCGCGAGG<br>GAGGC |
| hsIGK_0095_V020_J004_IGKV3-<br>11-<br>F_IGKJ4 | GCCTTGCCAGCCCGCTCAGCGCCAATAGTCTCCTACCAATTTCAGATAC SEQ ID NO:<br>CACCGGAGAAATTGTGTTGACACAGTCTCCAGCCACCCTGTCTTTGTCT 6161<br>CCAGGGGAAAGAGCCACCCTCTCCTGCAGGGCCAGTCAGAGTGTTAGCA<br>GCTACTTAGCCTGGTACCAACAGAAACCTGGCCAGGCTCCCAGGCTCCT<br>CATCTATGATGCATCCAACAGGGCCACTGGCATCCCAGCCAGGTTCAGT<br>GGCAGTGGGTCTGGGACAGACTTCACTCTCACCATCAGCAGCCTAGAGC<br>CTGAAGATTTTGCAGTTTATTACTGTCAGCAGCGTAGCAACTGACGCCA<br>ATAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATCGCCAATAGTCTCCTACTGATGGCGCGAGG<br>GAGGC |

| INFORMAL SEQUENCE LISTING | | |
|---|---|---|
| hsIGK_0096_V021_J004_IGKV3-<br>15-<br>F_IGKJ4 | GCCTTGCCAGCCCGCTCAGTCAAGCCTGTCTCCTACCAATTTCAGATAC<br>CACTGGAGAAATAGTGATGACGCAGTCTCCAGCCACCCTGTCTGTGTCT<br>CCAGGGGAAAGAGCCACCCTCTCCTGCAGGGCCAGTCAGAGTGTTAGCA<br>GCAACTTAGCCTGGTACCAGCAGAAACCTGGCCAGGCTCCCAGGCTCCT<br>CATCTATGGTGCATCCACCAGGGCCACTGGTATCCCAGCCAGGTTCAGT<br>GGCAGTGGGTCTGGGACAGAGTTCACTCTCACCATCAGCAGCCTGCAGT<br>CTGAAGATTTTGCAGTTTATTACTGTCAGCAGTATAATAACTGATCAAG<br>CCTGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTCAAGCCTGTCTCCTACTGATGGCGCGAGG<br>GAGGC | SEQ ID NO:<br>6162 |
| hsIGK_0097_V022_J004_IGKV3-<br>20-<br>F_IGKJ4 | GCCTTGCCAGCCCGCTCAGACGTGTGTGTCTCCTAATCTCAGATACCAC<br>CGGAGAAATTGTGTTGACGCAGTCTCCAGGCACCCTGTCTTTGTCTCCA<br>GGGGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTCCT<br>CATCTATGGTGCATCCAGCAGGGCCACTGGCATCCCAGACAGGTTCAGT<br>GGCAGTGGGTCTGGGACAGACTTCACTCTCACCATCAGCAGACTGGAGC<br>CTGAAGATTTTGCAGTGTATTACTGTCAGCAGTATGGTAGCTGAACGTG<br>TGTGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATACGTGTGTGTCTCCTACTGATGGCGCGAGG<br>GAGGC | SEQ ID NO:<br>6163 |
| hsIGK_0098_V023_J004_IGKV3-<br>NL4-<br>FNG_IGKJ4 | GCCTTGCCAGCCCGCTCAGTCCGTCTAGTCTCCTACCAATTTCAGATAC<br>CACCGGAGAAATTGTGTTGACACAGTCTCCAGCCACCCTGTCTTTGTCT<br>CCAGGGGAAAGAGCCACCCTCTCCTGCAGGGCCAGTCAGGGTGTTAGCA<br>GCTACTTAGCCTGGTACCAGCAGAAACCTGGCCAGGCTCCCAGGCTCCT<br>CATCTATGATGCATCCAACAGGGCCACTGGCATCCCAGCCAGGTTCAGT<br>GGCAGTGGGCCTGGGACAGACTTCACTCTCACCATCAGCAGCCTAGAGC<br>CTGAAGATTTTGCAGTTTATTACTGTCAGCAGCGTAGCAACTGATCCGT<br>CTAGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTCCGTCTAGTCTCCTACTGATGGCGCGAGG<br>GAGGC | SEQ ID NO:<br>6164 |
| hsIGK_0099_V024_J004_IGKV4-<br>01-<br>F_IGKJ4 | GCCTTGCCAGCCCGCTCAGAAGAGCTGGTCTCCTAGGGGACATCGTGAT<br>GACCCAGTCTCCAGACTCCCTGGCTGTGTCTCTGGGCGAGAGGGCCACC<br>ATCAACTGCAAGTCCAGCCAGAGTGTTTTATACAGCTCCAACAATAAGA<br>ACTACTTAGCTTGGTACCAGCAGAAACCAGGACAGCCTCCTAAGCTGCT<br>CATTTACTGGGCATCTACCCGGGAATCCGGGGTCCCTGACCGATTCAGT<br>GGCAGCGGGTCTGGGACAGATTTCACTCTCACCATCAGCAGCCTGCAGG<br>CTGAAGATGTGGCAGTTTATTACTGTCAGCAATATTATAGTTGAAAGAG<br>CTGGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATAAGAGCTGGTCTCCTACTGATGGCGCGAGG<br>GAGGC | SEQ ID NO:<br>6165 |
| hsIGK_0100_V025_J004_IGKV5-<br>02-<br>F_IGKJ4 | GCCTTGCCAGCCCGCTCAGTATCGCTCGTCTCCTACCATAATCAGATAC<br>CAGGGCAGAAACGACACTCACGCAGTCTCCAGCATTCATGTCAGCGACT<br>CCAGGAGACAAAGTCAACATCTCCTGCAAAGCCAGCCAAGACATTGATG<br>ATGATATGAACTGGTACCAACAGAAACCAGGAGAAGCTGCTATTTTCAT<br>TATTCAAGAAGCTACTACTCTCGTTCCTGGAATCCCACCTCGATTCAGT<br>GGCAGCGGGTATGGAACAGATTTTACCCTCACAATTAATAACATAGAAT<br>CTGAGGATGCTGCATATTACTTCTGTCTACAACATGATAATTGATATCG<br>CTCGTCTCCTAGTCGACCTTTCGGCGGAGGGACCAAGGTGGAGATCAAA<br>CGTAAGTGCACTTTCCTAATGCTTTTTCTTATAAGGTTTTAAATTTGGA<br>GCGTTTTTGTGTTTGAGATTATCGCTCGTCTCCTACTGATGGCGCGAGG<br>GAGGC | SEQ ID NO:<br>6166 |
| hsIGK_0101_V001_J005_IGKV1-<br>05-<br>F_IGKJ5 | GCCTTGCCAGCCCGCTCAGGTTCCGAAAGAGTGTCCCAATCTCAGGTGC<br>CAAATGTGACATCCAGATGACCCAGTCTCCTTCCACCCTGTCTGCATCT<br>GTAGGAGACAGAGTCACCATCACTTGCCGGGCCAGTCAGAGTATTAGTA<br>GCTGGTTGGCCTGGTATCAGCAGAAACCAGGGAAAGCCCCTAAGCTCCT<br>GATCTATAAGGCGTCTAGTTTAGAAAGTGGGGTCCCATCAAGGTTCAGC<br>GGCAGTGGATCTGGGACAGAATTCACTCTCACCATCAGCAGCCTGCAGC<br>CTGATGATTTTGCAACTTATTACTGCCAACAGTATAATAGTTGAGTTCC<br>GAAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGTTCCGAAAGAGTGTCCTGATGGCGCGAGG<br>GAGGC | SEQ ID NO:<br>6167 |
| hsIGK_0102_V002_J005_IGKV1-<br>06-<br>F_IGKJ5 | GCCTTGCCAGCCCGCTCAGCGTTACTTAGAGTGTCCCAATCTCAGGTGC<br>CAGATGTGCCATCCAGATGACCCAGTCTCCATCCTCCCTGTCTGCATCT<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCTCCT<br>GATCTATGCTGCATCCAGTTTACAAAGTGGGGTCCCATCAAGGTTCAGC | SEQ ID NO:<br>6168 |

| INFORMAL SEQUENCE LISTING | |
|---|---|
| | GGCAGTGGATCTGGCACAGATTTCACTCTCACCATCAGCAGCCTGCAGC<br>CTGAAGATTTTGCAACTTATTACTGTCTACAAGATTACAATTGACGTTA<br>CTTAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTCGTTACTTAGAGTGTCCTGATGGCGCGAGG<br>GAGGC |
| hsIGK_0103_V003_J005_IGKV1-<br>08-<br>F_IGKJ5 | GCCTTGCCAGCCCGCTCAGTAGGAGACAGAGTGTCCCAATCTCAGGTGC SEQ ID NO:<br>CAGATGTGCCATCCGGATGACCCAGTCTCCATCCTCATTCTCTGCATCT 6169<br>ACAGGAGACAGAGTCACCATCACTTGTCGGGCGAGTCAGGGTATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGATTTCACTCTCACCATCAGCTGCCTGCAGT<br>CTGAAGATTTTGCAACTTATTACTGTCAACAGTATTATAGTTGATAGGA<br>GACAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTAGGAGACAGAGTGTCCTGATGGCGCGAGG<br>GAGGC |
| hsIGK_0104_V004_J005_IGKV1-<br>09-<br>F_IGKJ5 | GCCTTGCCAGCCCGCTCAGGTGTCTACAGAGTGTCCCAATCTCAGGTGC SEQ ID NO:<br>CAGATGTGACATCCAGTTGACCCAGTCTCCATCCTTCCTGTCTGCATCT 6170<br>GTAGGAGACAGAGTCACCATCACTTGCCGGGCCAGTCAGGGCATTAGCA<br>GTTATTTAGCCTGGTATCAGCAAAAACCAGGGAAAGCCCCTAAGCTCCT<br>GATCTATGCTGCATCCACTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCAACAGCTTAATAGTTGAGTGTC<br>TACAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGTGTCTACAGAGTGTCCTGATGGCGCGAGG<br>GAGGC |
| hsIGK_0105_V005_J005_IGKV1-<br>12-<br>F_IGKJ5 | GCCTTGCCAGCCCGCTCAGGTACAGTGAGAGTGTCCCAATCTCAGGTTC SEQ ID NO:<br>CAGATGCGACATCCAGATGACCCAGTCTCCATCTTCCGTGTCTGCATCT 6171<br>GTAGGAGACAGAGTCACCATCACTTGTCGGGCGAGTCAGGGTATTAGCA<br>GCTGGTTAGCCTGGTATCAGCAGAAACCAGGGAAAGCCCCTAAGCTCCT<br>GATCTATGCTGCATCCAGTTTGCAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTACTATTGTCAACAGGCTAACAGTTGAGTACA<br>GTGAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGTACAGTGAGAGTGTCCTGATGGCGCGAGG<br>GAGGC |
| hsIGK_0106_V006_J005_IGKV1-<br>13-<br>FP_IGKJ5 | GCCTTGCCAGCCCGCTCAGGGATCATCAGAGTGTCCCAATCTCAGGTGC SEQ ID NO:<br>CAGATGTGCCATCCAGTTGACCCAGTCTCCATCCTCCCTGTCTGCATCT 6172<br>GTAGGAGACAGAGTCACCATCACTTGCCGGGCAAGTCAGGGCATTAGCA<br>GTGCTTTAGCCTGATATCAGCAGAAACCAGGGAAAGCTCCTAAGCTCCT<br>GATCTATGATGCCTCCAGTTTGGAAAGTGGGGTCCCATCAAGGTTCAGC<br>GGCAGTGGATCTGGGACAGATTTCACTCTCACCATCAGCAGCCTGCAGC<br>CTGAAGATTTTGCAACTTATTACTGTCAACAGTTTAATAATTGAGGATC<br>ATCAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGGATCATCAGAGTGTCCTGATGGCGCGAGG<br>GAGGC |
| hsIGK_0107_V007_J005_IGKV1-<br>16-<br>F_IGKJ5 | GCCTTGCCAGCCCGCTCAGTATTGGCGAGAGTGTCCCAATCTCAGGTGC SEQ ID NO:<br>CAGATGTGACATCCAGATGACCCAGTCTCCATCCTCACTGTCTGCATCT 6173<br>GTAGGAGACAGAGTCACCATCACTTGTCGGGCGAGTCAGGGCATTAGCA<br>ATTATTTAGCCTGGTTTCAGCAGAAACCAGGGAAAGCCCCTAAGTCCCT<br>GATCTATGCTGCATCCAGTTTGCAAAGTGGGGTCCCATCAAAGTTCAGC<br>GGCAGTGGATCTGGGACAGATTTCACTCTCACCATCAGCAGCCTGCAGC<br>CTGAAGATTTTGCAACTTATTACTGCCAACAGTATAATAGTTGATATTG<br>GCGAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTATTGGCGAGAGTGTCCTGATGGCGCGAGG<br>GAGGC |
| hsIGK_0108_V008_J005_IGKV1-<br>17-<br>F_IGKJ5 | GCCTTGCCAGCCCGCTCAGAGGCTTGAAGAGTGTCCCAATCTCAGGTGC SEQ ID NO:<br>CAGGTGTGACATCCAGATGACCCAGTCTCCATCCTCCCTGTCTGCATCT 6174<br>GTAGGAGACAGAGTCACCATCACTTGCCGGGCAAGTCAGGGCATTAGAA<br>ATGATTTAGGCTGGTATCAGCAGAAACCAGGGAAAGCCCCTAAGCGCCT<br>GATCTATGCTGCATCCAGTTTGCAAAGTGGGGTCCCATCAAGGTTCAGC<br>GGCAGTGGATCTGGGACAGAATTCACTCTCACAATCAGCAGCCTGCAGC<br>CTGAAGATTTTGCAACTTATTACTGTCTACAGCATAATAGTTGAAGGCT<br>TGAAGAGTGTCGTCGACCCTTCGGCCAAGGGACACGACTGGAGATTAAA |

| INFORMAL SEQUENCE LISTING | | |
|---|---|---|
| | CGTAAGTAATTTTTCACTATTGTCTTCTGAAATTTGGGTCTGATGGCCA<br>GTATTGACTTTTAGAGGCTAGGCTTGAAGAGTGTCCTGATGGCGCGAGG<br>GAGGC | |
| hsIGK_0109_V009_J005_IGKV1-<br>27-<br>F_IGKJ5 | GCCTTGCCAGCCCGCTCAGACACACGTAGAGTGTCCTAATATCAGATAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTATTTAGCCTGGTATCAGCAGAAACCAGGGAAAGTTCCTAAGCTCCT<br>GATCTATGCTGCATCCACTTTGCAATCAGGGGTCCCATCTCGGTTCAGT<br>GGCAGTGGATCTGGGACAGATTTCACTCTCACCATCAGCAGCCTGCAGC<br>CTGAAGATGTTGCAACTTATTACTGTCAAAAGTATAACAGTTGAACACA<br>CGTAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTACACACGTAGAGTGTCCTGATGGCGCGAGG<br>GAGGC | SEQ ID NO:<br>6175 |
| hsIGK_0110_V010_J005_IGKV1-<br>33-<br>F_IGKJ5 | GCCTTGCCAGCCCGCTCAGTAGACGGAAGAGTGTCCTAATCGCAGGTGC<br>CAGATGTGACATCCAGATGACCCAGTCTCCATCCTCCCTGTCTGCATCT<br>GTAGGAGACAGAGTCACCATCACTTGCCAGGCGAGTCAGGACATTAGCA<br>ACTATTTAAATTGGTATCAGCAGAAACCAGGGAAAGCCCCTAAGCTCCT<br>GATCTACGATGCATCCAATTTGGAAACAGGGGTCCCATCAAGGTTCAGT<br>GGAAGTGGATCTGGGACAGATTTTACTTTCACCATCAGCAGCCTGCAGC<br>CTGAAGATATTGCAACATATTACTGTCAACAGTATGATAATTGATAGAC<br>GGAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTAGACGGAAGAGTGTCCTGATGGCGCGAGG<br>GAGGC | SEQ ID NO:<br>6176 |
| hsIGK_0111_V011_J005_IGKV1-<br>37-<br>O_IGKJ5 | GCCTTGCCAGCCCGCTCAGCAGCTCTTAGAGTGTCCCAATCTCAGGTGC<br>CAGATGTGACATCCAGTTGACCCAGTCTCCATCCTCCCTGTCTGCATCT<br>GTAGGAGACAGAGTCACCATCACTTGCCGGGTGAGTCAGGGCATTAGCA<br>GTTATTTAAATTGGTATCGGCAGAAACCAGGGAAAGTTCCTAAGCTCCT<br>GATCTATAGTGCATCCAATTTGCAATCTGGAGTCCCATCTCGGTTCAGT<br>GGCAGTGGATCTGGGACAGATTTCACTCTCACTATCAGCAGCCTGCAGC<br>CTGAAGATGTTGCAACTTATTACGGTCAACGGACTTACAATTGACAGCT<br>CTTAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTCAGCTCTTAGAGTGTCCTGATGGCGCGAGG<br>GAGGC | SEQ ID NO:<br>6177 |
| hsIGK_0112_V012_J005_IGKV1-<br>39-<br>FP_IGKJ5 | GCCTTGCCAGCCCGCTCAGGAGCGATAAGAGTGTCCCAATCTCAGGTGC<br>CAGATGTGACATCCAGATGACCCAGTCTCCATCCTCCCTGTCTGCATCT<br>GTAGGAGACAGAGTCACCATCACTTGCCAAGTCAGAGCATTAGCA<br>GCTATTTAAATTGGTATCAGCAGAAACCAGGGAAAGCCCCTAAGCTCCT<br>GATCTATGCTGCATCCAGTTTGCAAAGTGGGGTCCCATCAAGGTTCAGT<br>GGCAGTGGATCTGGGACAGATTTCACTCTCACCATCAGCAGTCTGCAAC<br>CTGAAGATTTTGCAACTTACTACTGTCAACAGAGTTACAGTTGAGAGCG<br>ATAAGAGTGTCGTCGACCCTTCGGCAAGGGACACGACTGGAGATTAAA<br>CGTAAGTAATTTTTCACTATTGTCTTCTGAAATTTGGGTCTGATGGCCA<br>GTATTGACTTTTAGAGGCTGAGCGATAAGAGTGTCCTGATGGCGCGAGG<br>GAGGC | SEQ ID NO:<br>6178 |
| hsIGK_0113_V013_J005_IGKV1-<br>NL1-<br>F_IGKJ5 | GCCTTGCCAGCCCGCTCAGGCATCTGAAGAGTGTCCCAATCTCAGGTAC<br>CAGATGTGACATCCAGATGACCCAGTCTCCATCCTCCCTGTCTGCATCT<br>GTAGGAGACAGAGTCACCATCACTTGCCGGGCGAGTCAGGGCATTAGCA<br>ATTCTTTAGCCTGGTATCAGCAGAAACCAGGGAAAGCCCCTAAGCTCCT<br>GCTCTATGCTGCATCCAGATTGGAAAGTGGGGTCCCATCCAGGTTCAGT<br>GGCAGTGGATCTGGGACGGATTACACTCTCACCATCAGCAGCCTGCAGC<br>CTGAAGATTTTGCAACTTATTACTGTCAACAGTATTATAGTTGAGCATC<br>TGAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGCATCTGAAGAGTGTCCTGATGGCGCGAGG<br>GAGGC | SEQ ID NO:<br>6179 |
| hsIGK_0114_V014_J005_IGKV2-<br>24-<br>F_IGKJ5 | GCCTTGCCAGCCCGCTCAGTGCTACACAGAGTGTCAGTGGGGATATTGT<br>GATGACCCAGACTCCACTCTCCTCACCTGTCACCCTTGGACAGCCGGCC<br>TCCATCTCCTGCAGGTCTAGTCAAAGCCTCGTACACAGTGATGGAAACA<br>CCTACTTGAGTTGGCTTCAGCAGAGGCCAGGCCAGCCTCCAAGACTCCT<br>AATTTATAAGATTTCTAACCGGTTCTCTGGGGTCCCAGACAGATTCAGT<br>GGCAGTGGGGCAGGGACAGATTTCACACTGAAAATCAGCAGGGTGGAAG<br>CTGAGGATGTCGGGGTTATTACTGCATGCAAGCTACACAATGATGCTA<br>CACAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTGCTACACAGAGTGTCCTGATGGCGCGAGG<br>GAGGC | SEQ ID NO:<br>6180 |

-continued

INFORMAL SEQUENCE LISTING

| | | |
|---|---|---|
| hsIGK_0115_V015_J005_IGKV2-<br>28-<br>F_IGKJ5 | GCCTTGCCAGCCCGCTCAGAACTGCCAAGAGTGTCAGTGGGGATATTGT<br>GATGACTCAGTCTCCACTCTCCCTGCCCGTCACCCCTGGAGAGCCGGCC<br>TCCATCTCCTGCAGGTCTAGTCAGAGCCTCCTGCATAGTAATGGATACA<br>ACTATTTGGATTGGTACCTGCAGAAGCCAGGGCAGTCTCCACAGCTCCT<br>GATCTATTTGGGTTCTAATCGGGCCTCCGGGGTCCCTGACAGGTTCAGT<br>GGCAGTGGATCAGGCACAGATTTTACACTGAAAATCAGCAGAGTGGAGG<br>CTGAGGATGTTGGGGTTTATTACTGCATGCAAGCTCTACAATGAAACTG<br>CCAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTAACTGCCAAGAGTGTCCTGATGGCGCGAGG<br>GAGGC | SEQ ID NO:<br>6181 |
| hsIGK_0116_V016_J005_IGKV2-<br>29-<br>FP_IGKJ5 | GCCTTGCCAGCCCGCTCAGTTGGACTGAGAGTGTCAGTGCGGATATTGT<br>GATGACCCAGACTCCACTCTCTCTGTCCGTCACCCCTGGACAGCCGGCC<br>TCCATCTCCTGCAAGTCTAGTCAGAGCCTCCTGCATAGTGATGGAAAGA<br>CCTATTTGTATTGGTACCTGCAGAAGCCAGGCCAGTCTCCACAGCTCCT<br>GATCTATGAAGTTTCCAGCCGGTTCTCTGGAGTGCCAGATAGGTTCAGT<br>GGCAGCGGGTCAGGGACAGATTTCACACTGAAAATCAGCCGGGTGGAGG<br>CTGAGGATGTTGGGGTTTATTACTGAATGCAAGGTATACACTGATTGGA<br>CTGAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTTGGACTGAGAGTGTCCTGATGGCGCGAGG<br>GAGGC | SEQ ID NO:<br>6182 |
| hsIGK_0117_V017_J005_IGKV2-<br>30-<br>F_IGKJ5 | GCCTTGCCAGCCCGCTCAGGTAGACACAGAGTGTCAGTGGGGATGTTGT<br>GATGACTCAGTCTCCACTCTCCCTGCCCGTCACCCTTGGACAGCCGGCC<br>TCCATCTCCTGCAGGTCTAGTCAAAGCCTCGTATACAGTGGTGGAAACA<br>CCTACTTGAATTGGTTTCAGCAGAGGCCAGGCCAATCTCCAAGGCGCCT<br>AATTTATAAGGTTTCTAACCGGGACTCTGGGGTCCCAGACAGATTCAGC<br>GGCAGTGGGTCAGGCACTGATTTCACACTGAAAATCAGCAGGGTGGAGG<br>CTGAGGATGTTGGGGTTTATTACTGCATGCAAGGTACACACTGAGTAGA<br>CACAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGTAGACACAGAGTGTCCTGATGGCGCGAGG<br>GAGGC | SEQ ID NO:<br>6183 |
| hsIGK_0118_V018_J005_IGKV2-<br>40-<br>F_IGKJ5 | GCCTTGCCAGCCCGCTCAGCACTGTACAGAGTGTCGAGGATATTGTGAT<br>GACCCAGACTCCACTCTCCCTGCCCGTCACCCCTGGAGAGCCGGCCTCC<br>ATCTCCTGCAGGTCTAGTCAGAGCCTCTTGGATAGTGATGATGGAAACA<br>CCTATTTGGACTGGTACCTGCAGAAGCCAGGGCAGTCTCCACAGCTCCT<br>GATCTATACGCTTTCCTATCGGGCCTCTGGAGTCCCAGACAGGTTCAGT<br>GGCAGTGGGTCAGGCACTGATTTCACACTGAAAATCAGCAGGGTGGAGG<br>CTGAGGATGTTGGAGTTTATTACTGCATGCAACGTATAGAGTGACACTG<br>TACAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTCACTGTACAGAGTGTCCTGATGGCGCGAGG<br>GAGGC | SEQ ID NO:<br>6184 |
| hsIGK_0119_V019_J005_IGKV3-<br>07-<br>F_IGKJ5 | GCCTTGCCAGCCCGCTCAGGATGATCCAGAGTGTCATCTCAGATACCAC<br>CGGAGAAATTGTAATGACACAGTCTCCAGCCACCCTGTCTTTGTCTCCA<br>GGGGAAAGAGCCACCCTCTCCTGCAGGGCCAGTCAGAGTGTTAGCAGCA<br>GCTACTTATCCTGGTACCAGCAGAAACCTGGGCAGGCTCCCAGGCTCCT<br>CATCTATGGTGCATCCACCAGGGCCACTGGCATCCCAGCCAGGTTCAGT<br>GGCAGTGGGTCTGGGACAGACTTCACTCTCACCATCAGCAGCCTGCAGC<br>CTGAAGATTTTGCAGTTTATTACTGTCAGCAGGATTATAACTGAGATGA<br>TCCAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTGATGATCCAGAGTGTCCTGATGGCGCGAGG<br>GAGGC | SEQ ID NO:<br>6185 |
| hsIGK_0120_V020_J005_IGKV3-<br>11-<br>F_IGKJ5 | GCCTTGCCAGCCCGCTCAGCGCAATAAGAGTGTCCCAATTTCAGATAC<br>CACCGGAGAAATTGTGTTGACACAGTCTCCAGCCACCCTGTCTTTGTCT<br>CCAGGGGAAAGAGCCACCCTCTCCTGCAGGGCCAGTCAGAGTGTTAGCA<br>GCTACTTAGCCTGGTACCAACAGAAACCTGGCCAGGCTCCCAGGCTCCT<br>CATCTATGATGCATCCAACAGGGCCACTGGCATCCCAGCCAGGTTCAGT<br>GGCAGTGGGTCTGGGACAGACTTCACTCTCACCATCAGCAGCCTAGAGC<br>CTGAAGATTTTGCAGTTTATTACTGTCAGCAGCGTAGCAACTGACGCCA<br>ATAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTCGCAATAAGAGTGTCCTGATGGCGCGAGG<br>GAGGC | SEQ ID NO:<br>6186 |
| hsIGK_0121_V021_J005_IGKV3-<br>15-<br>F_IGKJ5 | GCCTTGCCAGCCCGCTCAGTCAAGCCTAGAGTGTCCCAATTTCAGATAC<br>CACTGGAGAAATAGTGATGACGCAGTCTCCAGCCACCCTGTCTGTGTCT<br>CCAGGGGAAAGAGCCACCCTCTCCTGCAGGGCCAGTCAGAGTGTTAGCA<br>GCAACTTAGCCTGGTACCAGCAGAAACCTGGCCAGGCTCCCAGGCTCCT | SEQ ID NO:<br>6187 |

| | INFORMAL SEQUENCE LISTING | |
|---|---|---|
| | CATCTATGGTGCATCCACCAGGGCCACTGGTATCCCAGCCAGGTTCAGT<br>GGCAGTGGGTCTGGGACAGAGTTCACTCTCACCATCAGCAGCCTGCAGT<br>CTGAAGATTTTGCAGTTTATTACTGTCAGCAGTATAATAACTGATCAAG<br>CCTAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTCAAGCCTAGAGTGTCCTGATGGCGCGAGG<br>GAGGC | |
| hsIGK_0122_V022_J005_IGKV3-<br>20-<br>F_IGKJ5 | GCCTTGCCAGCCCGCTCAGACGTGTGTAGAGTGTCATCTCAGATACCAC<br>CGGAGAAATTGTGTTGACGCAGTCTCCAGGCACCCTGTCTTTGTCTCCA<br>GGGGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTCCT<br>CATCTATGGTGCATCCAGCAGGGCCACTGGCATCCCAGACAGGTTCAGT<br>GGCAGTGGGTCTGGGACAGACTTCACTCTCACCATCAGCAGACTGGAGC<br>CTGAAGATTTTGCAGTGTATTACTGTCAGCAGTATGGTAGCTGAACGTG<br>TGTAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTACGTGTGTAGAGTGTCCTGATGGCGCGAGG<br>GAGGC | SEQ ID NO:<br>6188 |
| hsIGK_0123_V023_J005_IGKV3-<br>NL4-<br>FNG_IGKJ5 | GCCTTGCCAGCCCGCTCAGTCCGTCTAAGAGTGTCCCAATTTCAGATAC<br>CACCGGAGAAATTGTGTTGACACAGTCTCCAGCCACCCTGTCTTTGTCT<br>CCAGGGGAAAGAGCCACCCTCTCCTGCAGGGCCAGTCAGGGTGTTAGCA<br>GCTACTTAGCCTGGTACCAGCAGAAACCTGGCCAGGCTCCCAGGCTCCT<br>CATCTATGATGCATCCAACAGGGCCACTGGCATCCCAGCCAGGTTCAGT<br>GGCAGTGGGCCTGGGACAGACTTCACTCTCACCATCAGCAGCCTAGAGC<br>CTGAAGATTTTGCAGTTTATTACTGTCAGCAGCGTAGCAACTGATCCGT<br>CTAAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTCCGTCTAAGAGTGTCCTGATGGCGCGAGG<br>GAGGC | SEQ ID NO:<br>6189 |
| hsIGK_0124_V024_J005_IGKV4-<br>01-<br>F_IGKJ5 | GCCTTGCCAGCCCGCTCAGAAGAGCTGAGAGTGTCGGGGACATCGTGAT<br>GACCCAGTCTCCAGACTCCCTGGCTGTGTCTCTGGGCGAGAGGGCCACC<br>ATCAACTGCAAGTCCAGCCAGAGTGTTTTATACAGCTCCAACAATAAGA<br>ACTACTTAGCTTGGTACCAGCAGAAACCAGGACAGCCTCCTAAGCTGCT<br>CATTTACTGGGCATCTACCCGGGAATCCGGGGTCCCTGACCGATTCAGT<br>GGCAGCGGGTCTGGGACAGATTTCACTCTCACCATCAGCAGCCTGCAGG<br>CTGAAGATGTGGCAGTTTATTACTGTCAGCAATATTATAGTTGAAAGAG<br>CTGAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTAAGAGCTGAGAGTGTCCTGATGGCGCGAGG<br>GAGGC | SEQ ID NO:<br>6190 |
| hsIGK_0125_V025_J005_IGKV5-<br>02-<br>F_IGKJ5 | GCCTTGCCAGCCCGCTCAGTATCGCTCAGAGTGTCCCATAATCAGATAC<br>CAGGGCAGAAACGACACTCACGCAGTCTCCAGCATTCATGTCAGCGACT<br>CCAGGAGACAAAGTCAACATCTCCTGCAAAGCCAGCCAAGACATTGATG<br>ATGATATGAACTGGTACCAACAGAAACCAGGAGAAGCTGCTATTTTCAT<br>TATTCAAGAAGCTACTACTCTCGTTCCTGGAATCCCACCTCGATTCAGT<br>GGCAGCGGGTATGGAACAGATTTTACCCTCACAATTAATAACATAGAAT<br>CTGAGGATGCTGCATATTACTTCTGTCTACAACATGATAATTGATATCG<br>CTCAGAGTGTCGTCGACCCTTCGGCCAAGGGACACGACTGGAGATTAAA<br>CGTAAGTAATTTTTCACTATTGTCTTCTGAAATTTGGGTCTGATGGCCA<br>GTATTGACTTTTAGAGGCTTATCGCTCAGAGTGTCCTGATGGCGCGAGG<br>GAGGC | SEQ ID NO:<br>6191 |

| Target | Gene specific primer sequence | Primer With Universal Sequence | SEQ ID NO |
|---|---|---|---|
| Primer Sequences for hs-TCR13-P10 | | | |
| TCRBV01 | GAATGCCCTGACAGCTCTCGC<br>TTATA | GGGCTGGCAAGCCACGTTTGGTGG<br>AATGCCCTGACAGCTCTCGCTTAT<br>A | SEQ ID NO:<br>6192 |
| TCRBV02 | CTCAGAGAAGTCTGAAATATT<br>CGATGATCAATTCTCAGTTG | GGGCTGGCAAGCCACGTTTGGTGC<br>TCAGAGAAGTCTGAAATATTCGAT<br>GATCAATTCTCAGTTG | SEQ ID NO:<br>6193 |
| TCRBV03-1 | CCAAATCGMTTCTCACCTAAA<br>TCTCCAGACAAAG | GGGCTGGCAAGCCACGTTTGGTGC<br>CAAATCGMTTCTCACCTAAATCTC<br>CAGACAAAG | SEQ ID NO:<br>6194 |
| TCRBV03-2 | CACCTGACTCTCCAGACAAAG<br>CTCAT | GGGCTGGCAAGCCACGTTTGGTGC<br>ACCTGACTCTCCAGACAAAGCTCA<br>T | SEQ ID NO:<br>6195 |

INFORMAL SEQUENCE LISTING

| | | | |
|---|---|---|---|
| TCRBV04-1/2/3 | CCTGAATGCCCCAACAGCTCTC | GGGCTGGCAAGCCACGTTTGGTGCCTGAATGCCCCAACAGCTCTC | SEQ ID NO: 6196 |
| TCRBV05-1 | GATTCTCAGGGCGCCAGTTCTCTA | GGGCTGGCAAGCCACGTTTGGTGGATTCTCAGGGCGCCAGTTCTCTA | SEQ ID NO: 6197 |
| TCRBV05-2 | CCTAATTGATTCTCAGCTCACCACGTCCATA | GGGCTGGCAAGCCACGTTTGGTGCCTAATTGATTCTCAGCTCACCACGTCCATA | SEQ ID NO: 6198 |
| TCRBV05-3 | TCAGGGCGCCAGTTCCATG | GGGCTGGCAAGCCACGTTTGGTGTCAGGGCGCCAGTTCCATG | SEQ ID NO: 6199 |
| TCRBV05-4 | TCCTAGATTCTCAGGTCTCCAGTTCCCTA | GGGCTGGCAAGCCACGTTTGGTGTCCTAGATTCTCAGGTCTCCAGTTCCCTA | SEQ ID NO: 6200 |
| TCRBV05-5 | GAGGAAACTTCCCTGATCGATTCTCAGC | GGGCTGGCAAGCCACGTTTGGTGGAGGAAACTTCCCTGATCGATTCTCAGC | SEQ ID NO: 6201 |
| TCRBV05-6 | CAACTTCCCTGATCGATTCTCAGGTCA | GGGCTGGCAAGCCACGTTTGGTGCAACTTCCCTGATCGATTCTCAGGTCA | SEQ ID NO: 6202 |
| TCRBV05-7 | AGGAAACTTCCCTGATCAATTCTCAGGTCA | GGGCTGGCAAGCCACGTTTGGTGAGGAAACTTCCCTGATCAATTCTCAGGTCA | SEQ ID NO: 6203 |
| TCRBV05-8 | GGAAACTTCCCTCCTAGATTTTCAGGTCG | GGGCTGGCAAGCCACGTTTGGTGGGAAACTTCCCTCCTAGATTTTCAGGTCG | SEQ ID NO: 6204 |
| TCRBV06-1 | CCCCAATGGCTACAATGTCTCCAGATT | GGGCTGGCAAGCCACGTTTGGTGCCCCAATGGCTACAATGTCTCCAGATT | SEQ ID NO: 6205 |
| TCRBV06-2/3 | GGAGAAGTCCCCAATGGCTACAA | GGGCTGGCAAGCCACGTTTGGTGGGAGAGGTCCCTGATGGCTACAA | SEQ ID NO: 6206 |
| TCRBV06-4 | TCCCTGATGGTTATAGTGTCTCCAGAGC | GGGCTGGCAAGCCACGTTTGGTGTCCCTGATGGTTATAGTGTCTCCAGAGC | SEQ ID NO: 6207 |
| TCRBV06-5 | GGAGAAGTCCCCAATGGCTACAATGTC | GGGCTGGCAAGCCACGTTTGGTGGGAGAAGTCCCCAATGGCTACAATGTC | SEQ ID NO: 6208 |
| TCRBV06-6 | AAAGGAGAAGTCCCGAATGGCTACAA | GGGCTGGCAAGCCACGTTTGGTGAAAGGAGAAGTCCCGAATGGCTACAA | SEQ ID NO: 6209 |
| TCRBV06-7 | GTTCCCAATGGCTACAATGTCTCCAGATC | GGGCTGGCAAGCCACGTTTGGTGGTTCCCAATGGCTACAATGTCTCCAGATC | SEQ ID NO: 6210 |
| TCRBV06-8 | GAAGTCCCCAATGGCTACAATGTCTCTAGATT | GGGCTGGCAAGCCACGTTTGGTGGAAGTCCCCAATGGCTACAATGTCTCTAGATT | SEQ ID NO: 6211 |
| TCRBV06-9 | GAGAAGTCCCCGATGGCTACAATGTA | GGGCTGGCAAGCCACGTTTGGTGGAGAAGTCCCCGATGGCTACAATGTA | SEQ ID NO: 6212 |
| TCRBV07-1 | GTGATCGGTTCTCTGCACAGAGGT | GGGCTGGCAAGCCACGTTTGGTGGTGATCGGTTCTCTGCACAGAGGT | SEQ ID NO: 6213 |
| TCRBV07-2 | CGCTTCTCTGCAGAGAGGACTGG | GGGCTGGCAAGCCACGTTTGGTGCGCTTCTCTGCAGAGAGGACTGG | SEQ ID NO: 6214 |
| TCRBV07-3 | GGTTCTTTGCAGTCAGGCCTGA | GGGCTGGCAAGCCACGTTTGGTGGGTTCTTTGCAGTCAGGCCTGA | SEQ ID NO: 6215 |
| TCRBV07-4 | CAGTGGTCGGTTCTCTGCAGAG | GGGCTGGCAAGCCACGTTTGGTGAGTGGTCGGTTCTCTGCAGAG | SEQ ID NO: 6216 |

| INFORMAL SEQUENCE LISTING | | | |
|---|---|---|---|
| TCRBV07-5 | GCTCAGTGATCAATTCTCCAC AGAGAGGT | GGGCTGGCAAGCCACGTTTGGTGG CTCAGTGATCAATTCTCCACAGAG AGGT | SEQ ID NO: 6217 |
| TCRBV07-6/7 | TTCTCTGCAGAGAGGCCTGAG G | GGGCTGGCAAGCCACGTTTGGTGT TCTCTGCAGAGAGGCCTGAGG | SEQ ID NO: 6218 |
| TCRBV07-8 | CCCAGTGATCGCTTCTTTGCA GAAA | GGGCTGGCAAGCCACGTTTGGTGC CCAGTGATCGCTTCTTTGCAGAAA | SEQ ID NO: 6219 |
| TCRBV07-9 | CTGCAGAGAGGCCTAAGGGAT CT | GGGCTGGCAAGCCACGTTTGGTGC TGCAGAGAGGCCTAAGGGATCT | SEQ ID NO: 6220 |
| TCRBV08-1 | GAAGGGTACAATGTCTCTGGA AACAAACTCAAG | GGGCTGGCAAGCCACGTTTGGTGG AAGGGTACAATGTCTCTGGAAACA AACTCAAG | SEQ ID NO: 6221 |
| TCRBV08-2 | GGGGTACTGTGTTTCTTGAAA CAAGCTTGAG | GGGCTGGCAAGCCACGTTTGGTGG GGGTACTGTGTTTCTTGAAACAAG CTTGAG | SEQ ID NO: 6222 |
| TCRBV09 | CAGTTCCCTGACTTGCACTCT GAACTAAAC | GGGCTGGCAAGCCACGTTTGGTGC AGTTCCCTGACTTGCACTCTGAAC TAAAC | SEQ ID NO: 6223 |
| TCRBV10-1 | ACTAACAAAGGAGAAGTCTCA GATGGCTACAG | GGGCTGGCAAGCCACGTTTGGTGA CTAACAAAGGAGAAGTCTCAGATG GCTACAG | SEQ ID NO: 6224 |
| TCRBV10-2 | AGATAAAGGAGAAGTCCCCGA TGGCTA | GGGCTGGCAAGCCACGTTTGGTGA GATAAAGGAGAAGTCCCCGATGGC TA | SEQ ID NO: 6225 |
| TCRBV10-3 | GATACTGACAAAGGAGAAGTC TCAGATGGCTATAG | GGGCTGGCAAGCCACGTTTGGTGG ATACTGACAAAGGAGAAGTCTCAG ATGGCTATAG | SEQ ID NO: 6226 |
| TCRBV11-1/2/3 | CTAAGGATCGATTTTCTGCAG AGAGGCTC | GGGCTGGCAAGCCACGTTTGGTGC TAAGGATCGATTTTCTGCAGAGAG GCTC | SEQ ID NO: 6227 |
| TCRBV12-1 | TTGATTCTCAGCACAGATGCC TGATGT | GGGCTGGCAAGCCACGTTTGGTGT TGATTCTCAGCACAGATGCCTGAT GT | SEQ ID NO: 6228 |
| TCRBV12-2 | ATTCTCAGCTGAGAGGCCTGA TGG | GGGCTGGCAAGCCACGTTTGGTGA TTCTCAGCTGAGAGGCCTGATGG | SEQ ID NO: 6229 |
| TCRBV12-3/4 | GGATCGATTCTCAGCTAAGAT GCCTAATGC | GGGCTGGCAAGCCACGTTTGGTGG GATCGATTCTCAGCTAAGATGCCT AATGC | SEQ ID NO: 6230 |
| TCRBV12-5 | CTCAGCAGAGATGCCTGATGC AACTTTA | GGGCTGGCAAGCCACGTTTGGTGC TCAGCAGAGATGCCTGATGCAACT TTA | SEQ ID NO: 6231 |
| TCRBV13 | CTGATCGATTCTCAGCTCAAC AGTTCAGT | GGGCTGGCAAGCCACGTTTGGTGC TGATCGATTCTCAGCTCAACAGTT CAGT | SEQ ID NO: 6232 |
| TCRBV14 | TAGCTGAAAGGACTGGAGGGA CGTAT | GGGCTGGCAAGCCACGTTTGGTGT AGCTGAAAGGACTGGAGGGACGTA T | SEQ ID NO: 6233 |
| TCRBV15 | CCAGGAGGCCGAACACTTCTT TCT | GGGCTGGCAAGCCACGTTTGGTGC CAGGAGGCCGAACACTTCTTTCT | SEQ ID NO: 6234 |
| TCRBV16 | GCTAAGTGCCTCCCAAATTCA CCCT | GGGCTGGCAAGCCACGTTTGGTGG CTAAGTGCCTCCCAAATTCACCCT | SEQ ID NO: 6235 |
| TCRBV17 | CACAGCTGAAAGACCTAACGG AACGT | GGGCTGGCAAGCCACGTTTGGTGC ACAGCTGAAAGACCTAACGGAACG T | SEQ ID NO: 6236 |
| TCRBV18 | CTGCTGAATTTCCCAAAGAGG GCC | GGGCTGGCAAGCCACGTTTGGTGC TGCTGAATTTCCCAAAGAGGGCC | SEQ ID NO: 6237 |

| INFORMAL SEQUENCE LISTING | | | |
|---|---|---|---|
| TCRBV19 | AGGGTACAGCGTCTCTCGGG | GGGCTGGCAAGCCACGTTTGGTGA GGGTACAGCGTCTCTCGGG | SEQ ID NO: 6238 |
| TCRBV20 | GCCTGACCTTGTCCACTCTGA CA | GGGCTGGCAAGCCACGTTTGGTGG CCTGACCTTGTCCACTCTGACA | SEQ ID NO: 6239 |
| TCRBV21 | ATGAGCGATTTTTAGCCCAAT GCTCCA | GGGCTGGCAAGCCACGTTTGGTGA TGAGCGATTTTTAGCCCAATGCTC CA | SEQ ID NO: 6240 |
| TCRBV22 | TGAAGGCTACGTGTCTGCCAA GAG | GGGCTGGCAAGCCACGTTTGGTGT GAAGGCTACGTGTCTGCCAAGAG | SEQ ID NO: 6241 |
| TCRBV23 | CTCATCTCAATGCCCCAAGAA CGC | GGGCTGGCAAGCCACGTTTGGTGC TCATCTCAATGCCCCAAGAACGC | SEQ ID NO: 6242 |
| TCRBV24 | AGATCTCTGATGGATACAGTG TCTCTCGACA | GGGCTGGCAAGCCACGTTTGGTGA GATCTCTGATGGATACAGTGTCTC TCGACA | SEQ ID NO: 6243 |
| TCRBV25 | AGATCTTTCCTCTGAGTCAAC AGTCTCCAGAATA | GGGCTGGCAAGCCACGTTTGGTGA GATCTTTCCTCTGAGTCAACAGTC TCCAGAATA | SEQ ID NO: 6244 |
| TCRBV26 | CACTGAAAAAGGAGATATCTC TGAGGGGTATCATG | GGGCTGGCAAGCCACGTTTGGTGC ACTGAAAAAGGAGATATCTCTGAG GGGTATCATG | SEQ ID NO: 6245 |
| TCRBV27 | GTTCCTGAAGGGTACAAAGTC TCTCGAAAAG | GGGCTGGCAAGCCACGTTTGGTGG TTCCTGAAGGGTACAAAGTCTCTC GAAAAG | SEQ ID NO: 6246 |
| TCRBV28 | CTGAGGGGTACAGTGTCTCTA GAGAGA | GGGCTGGCAAGCCACGTTTGGTGC TGAGGGGTACAGTGTCTCTAGAGA GA | SEQ ID NO: 6247 |
| TCRBV29 | AGCCGCCCAAACCTAACATTC TCAA | GGGCTGGCAAGCCACGTTTGGTGA GCCGCCCAAACCTAACATTCTCAA | SEQ ID NO: 6248 |
| TCRBV30 | CCCAGGACCGGCAGTTCA | GGGCTGGCAAGCCACGTTTGGTGC CCAGGACCGGCAGTTCA | SEQ ID NO: 6249 |
| TCRBVA | TTGATTAGAGACATATCCCTA TTGAAAATATTTCCTGGCA | GGGCTGGCAAGCCACGTTTGGTGT TGATTAGAGACATATCCCTATTGA AAATATTTCCTGGCA | SEQ ID NO: 6250 |
| TCRBVB | AGATGCCCTGAGTCAGCATAG TCATTCTAAC | GGGCTGGCAAGCCACGTTTGGTGA GATGCCCTGAGTCAGCATAGTCAT TCTAAC | SEQ ID NO: 6251 |
| TCRBJ1-1 | GTCTTACCTACAACTGTGAGT CTGGTGCC | CCGGGAGCTGCATGTGTCAGAGGG TCTTACCTACAACTGTGAGTCTGG TGCC | SEQ ID NO: 6252 |
| TCRBJ1-2 | CCTTACCTACAACGGTTAACC TGGTCCC | CCGGGAGCTGCATGTGTCAGAGGC CTTACCTACAACGGTTAACCTGGT CCC | SEQ ID NO: 6253 |
| TCRBJ1-3 | CTTACTCACCTACAACAGTGA GCCAACTTCC | CCGGGAGCTGCATGTGTCAGAGGC TTACTCACCTACAACAGTGAGCCA ACTTCC | SEQ ID NO: 6254 |
| TCRBJ1-4 | ATACCCAAGACAGAGAGCTGG GTTCC | CCGGGAGCTGCATGTGTCAGAGGA TACCCAAGACAGAGAGCTGGGTTC C | SEQ ID NO: 6255 |
| TCRBJ1-5 | AACTTACCTAGGATGGAGAGT CGAGTCCC | CCGGGAGCTGCATGTGTCAGAGGA ACTTACCTAGGATGGAGAGTCGAG TCCC | SEQ ID NO: 6256 |
| TCRBJ1-6 | CTGTCACAGTGAGCCTGGTCC C | CCGGGAGCTGCATGTGTCAGAGGC TGTCACAGTGAGCCTGGTCCC | SEQ ID NO: 6257 |
| TCRBJ2-1 | CACGGTGAGCCGTGTCCC | CCGGGAGCTGCATGTGTCAGAGGC ACGGTGAGCCGTGTCCC | SEQ ID NO: 6258 |

| | | | |
|---|---|---|---|
| TCRBJ2-2 | CCAGTACGGTCAGCCTAGAGCC | CCGGGAGCTGCATGTGTCAGAGGCCAGTACGGTCAGCCTAGAGCC | SEQ ID NO: 6259 |
| TCRBJ2-3 | CACTGTCAGCCGGGTGCC | CCGGGAGCTGCATGTGTCAGAGGCACTGTCAGCCGGGTGCC | SEQ ID NO: 6260 |
| TCRBJ2-4 | CACTGAGAGCCGGGTCCC | CCGGGAGCTGCATGTGTCAGAGGCACTGAGAGCCGGGTCCC | SEQ ID NO: 6261 |
| TCRBJ2-5 | ACCAGGAGCCGCGTGCC | CCGGGAGCTGCATGTGTCAGAGGACCAGGAGCCGCGTGCC | SEQ ID NO: 6262 |
| TCRBJ2-6 | CACGGTCAGCCTGCTGCC | CCGGGAGCTGCATGTGTCAGAGGCACTGTCAGCCGGGTGCC | SEQ ID NO: 6263 |
| TCRBJ2-7 | GACCGTGAGCCTGGTGCC | CCGGGAGCTGCATGTGTCAGAGGGACCGTGAGCCTGGTGCC | SEQ ID NO: 6264 |
| Primer Sequences for hs-IGH-D | | | |
| IGHD1-14_ver10 | CGCTAGCTGGGGCTCACAGTGCTCA | GGGCTGGCAAGCCACGTTTGGTGCGCTAGCTGGGGCTCACAGTGCTCA | SEQ ID NO: 6265 |
| IGHD2-02_ver10 | CACTGGGCTCAGAGTCCTCTCCCACAC | GGGCTGGCAAGCCACGTTTGGTGCACTGGGCTCAGAGTCCTCTCCCACAC | SEQ ID NO: 6266 |
| IGHD2-15_ver10 | CCTATACAGCACTGGGCTCAGAGTCCTCTCTGAGAC | GGGCTGGCAAGCCACGTTTGGTGCCTATACAGCACTGGGCTCAGAGTCCTCTCTGAGAC | SEQ ID NO: 6267 |
| IGHD3-03_ver10 | CCTAAGCCAGGGGCAGACCCGAGT | GGGCTGGCAAGCCACGTTTGGTGCCTAAGCCAGGGGCAGACCCGAGT | SEQ ID NO: 6268 |
| IGHD3-10_ver10 | ACAGTGTCACAGAGTCCATCAAAAACCCATGCCTGG | GGGCTGGCAAGCCACGTTTGGTGACAGTGTCACAGAGTCCATCAAAAACCCATGCCTGG | SEQ ID NO: 6269 |
| IGHD3-16_ver10 | CACTATCCACATAAGCGAGGGACAGACCCGAGT | GGGCTGGCAAGCCACGTTTGGTGACTATCCACATAAGCGAGGGACAGACCCGAGT | SEQ ID NO: 6270 |
| IGHD4-04_ver10 | TGCCCTCGATGGCAGGCGGA | GGGCTGGCAAGCCACGTTTGGTGTGCCCTCGATGGCAGGCGGA | SEQ ID NO: 6271 |
| IGHD4-11_ver10 | CCTCTTCCAGGACAGTCCTCAGTGGCATCACAG | GGGCTGGCAAGCCACGTTTGGTGCCTCTTCCAGGACAGTCCTCAGTGGCATCACAG | SEQ ID NO: 6272 |
| IGHD4-23_ver10 | CAGACCCACCTGCCCTCAATGGCAG | GGGCTGGCAAGCCACGTTTGGTGCAGACCCACCTGCCCTCAATGGCAG | SEQ ID NO: 6273 |
| IGHD5-12_ver10 | TCTCCAGGGAGACACTGTGCATGTCTGGTACCTAA | GGGCTGGCAAGCCACGTTTGGTGTCTCCAGGGAGACACTGTGCATGTCTGGTACCTAA | SEQ ID NO: 6274 |
| IGHD5-24_ver10 | GGGACACAGTGCATGTCTGGTCCCTGA | GGGCTGGCAAGCCACGTTTGGTGGGACACAGTGCATGTCTGGTCCCTGA | SEQ ID NO: 6275 |
| IGHD6-13_ver10 | GGACCCCTATTCCAGACACCAGACAGAGGC | GGGCTGGCAAGCCACGTTTGGTGGGACCCCTATTCCAGACACCAGACAGAGGC | SEQ ID NO: 6276 |
| IGHD6-19_ver10 | CCCCACTCCAGACACCAGACAGAGGG | GGGCTGGCAAGCCACGTTTGGTGCCCCACTCCAGACACCAGACAGAGGG | SEQ ID NO: 6277 |
| IGHD7-27_ver10 | GGGGTCTCCCACGTGTTTTGGGGCTAAC | GGGCTGGCAAGCCACGTTTGGTGGGGTCTCCCACGTGTTTTGGGGCTAAC | SEQ ID NO: 6278 |
| IGHD1-26_ver10 | GCTAGCTGGGGCTGCCAGTCCTCA | GGGCTGGCAAGCCACGTTTGGTGGCTAGCTGGGGCTGCCAGTCCTCA | SEQ ID NO: 6279 |

INFORMAL SEQUENCE LISTING

Primer Sequences for IGK and IGL

| | | | |
|---|---|---|---|
| IGK_V_01-05_F_D10 | TCTGCATCTGTAGGAGACA GAGTCACCATCACTTG | GGGCTGGCAAGCCACGTTTGG TGTCTGCATCTGTAGGAGACA GAGTCACCATCACTTG | SEQ ID NO: 6280 |
| IGK_V_01-08_F_D10 | TCTGCATCTACAGGAGACA GAGTCACCATCACTTG | GGGCTGGCAAGCCACGTTTGG TGTCTGCATCTACAGGAGACA GAGTCACCATCACTTG | SEQ ID NO: 6281 |
| IGK_V_01-35_P_D10 | CTGCATCTGTAAGGAGACA GTGTCACCATCACTTG | GGGCTGGCAAGCCACGTTTGG TGCTGCATCTGTAAGGAGACA GTGTCACCATCACTTG | SEQ ID NO: 6282 |
| IGK_V_1D-08_F_D10 | TCTGCATCTACAGGAGACA GAGTCACCATCAGTTG | GGGCTGGCAAGCCACGTTTGG TGTCTGCATCTACAGGAGACA GAGTCACCATCAGTTG | SEQ ID NO: 6283 |
| IGK_V_1D-22_P_D10 | ACTGCATCTGTAGGAGAGA GAGTCACCATCACTTG | GGGCTGGCAAGCCACGTTTGG TGACTGCATCTGTAGGAGAGA GAGTCACCATCACTTG | SEQ ID NO: 6284 |
| IGK_V_1D-35_P_D10 | GCATCTGTAAGGAGACAGC GTCACCATCACTTG | GGGCTGGCAAGCCACGTTTGG TGGCATCTGTAAGGAGACAGC GTCACCATCACTTG | SEQ ID NO: 6285 |
| IGK_V_1D-42_F_D10 | GTCTGCATCTGTAGGAGAC AGAGTCAGTATCATTTG | GGGCTGGCAAGCCACGTTTGG TGGTCTGCATCTGTAGGAGAC AGAGTCAGTATCATTTG | SEQ ID NO: 6286 |
| IGK_V_02-04_P_D10 | GGAGAGCCGGCCTCCATCT CCTG | GGGCTGGCAAGCCACGTTTGG TGGGAGAGCCGGCCTCCATCT CCTG | SEQ ID NO: 6287 |
| IGK_V_02-10_P_D10 | CCTGGAGAGCCAGCCTCCA TCTCCTG | GGGCTGGCAAGCCACGTTTGG TGCCTGGAGAGCCAGCCTCCA TCTCCTG | SEQ ID NO: 6288 |
| IGK_V_02-18_P_D10 | CTGGAGAGCCGGCCTCCAT CTCTTG | GGGCTGGCAAGCCACGTTTGG TGCTGGAGAGCCGGCCTCCAT CTCTTG | SEQ ID NO: 6289 |
| IGK_V_02-19_P_D10 | TCTTCCTTGGAGAGCCATC CTCCATTTCCTG | GGGCTGGCAAGCCACGTTTGG TGTCTTCCTTGGAGAGCCATC CTCCATTTCCTG | SEQ ID NO: 6290 |
| IGK_V_02-24_F_D10 | GGACAGCCGGCCTCCATCT CCTG | GGGCTGGCAAGCCACGTTTGG TGGGACAGCCGGCCTCCATCT CCTG | SEQ ID NO: 6291 |
| IGK_V_02-28_F_D10 | TGGAGAGCCGGCCTCCATC TCCTG | GGGCTGGCAAGCCACGTTTGG TGTGGAGAGCCGGCCTCCATC TCCTG | SEQ ID NO: 6292 |
| IGK_V_02-38_P_D10 | ATAATATTTGTACATAACT TTGTACTTCATCTCCTG | GGGCTGGCAAGCCACGTTTGG TGATAATATTTGTACATAACT TTGTACTTCATCTCCTG | SEQ ID NO: 6293 |
| IGK_V_2D-14_P_D10 | CCCCTGGAAAGCCAGCCTC TATCTCCTG | GGGCTGGCAAGCCACGTTTGG TGCCCCTGGAAAGCCAGCCTC TATCTCCTG | SEQ ID NO: 6294 |
| IGK_V_2D-19_P_D10 | CTCTTCCTTGGAGAGCCAT CCTCCATTTCCTG | GGGCTGGCAAGCCACGTTTGG TGCTCTTCCTTGGAGAGCCAT CCTCCATTTCCTG | SEQ ID NO: 6295 |
| IGK_V_2D-24_O_D10 | GGACAGCCGGCCTCCATCT CCTT | GGGCTGGCAAGCCACGTTTGG TGGGACAGCCGGCCTCCATCT CCTT | SEQ ID NO: 6296 |
| IGK_V_2D-26_F_D10 | CCTGGAGAGCAGGCCTCCA TGTCCTG | GGGCTGGCAAGCCACGTTTGG TGCCTGGAGAGCAGGCCTCCA TGTCCTG | SEQ ID NO: 6297 |

| INFORMAL SEQUENCE LISTING | | | |
|---|---|---|---|
| IGK_V_03-07_F_D10 | CCAGGGGAAAGAGCCACCC TCTCCTG | GGGCTGGCAAGCCACGTTTGG TGCCAGGGGAAAGAGCCACCC TCTCCTG | SEQ ID NO: 6298 |
| IGK_V_03-07_P_D10 | TCCAGGGGAAAGAGTCACC CTCTCCTG | GGGCTGGCAAGCCACGTTTGG TGTCCAGGGGAAAGAGTCACC CTCTCCTG | SEQ ID NO: 6299 |
| IGK_V_03-25_P_D10 | TCTTTGTCTCTGGAGAAAA AAGCCACCCTGACTTG | GGGCTGGCAAGCCACGTTTGG TGTCTTTGTCTCTGGAGAAAA AAGCCACCCTGACTTG | SEQ ID NO: 6300 |
| IGK_V_03-31_P_D10 | TCTCTAGGGGAAAAAGCCA CCCTCACCTA | GGGCTGGCAAGCCACGTTTGG TGTCTCTAGGGGAAAAAGCCA CCCTCACCTA | SEQ ID NO: 6301 |
| IGK_V_03-34_P_D10 | GGGGAAGGAGCCACCCTCA CCTG | GGGCTGGCAAGCCACGTTTGG TGGGGGAAGGAGCCACCCTCA CCTG | SEQ ID NO: 6302 |
| IGK_V_04-01_F_D10 | GGGCGAGAGGGCCACCATC AACTG | GGGCTGGCAAGCCACGTTTGG TGGGGCGAGAGGGCCACCATC AACTG | SEQ ID NO: 6303 |
| IGK_V_05-02_F_D10 | GCGACTCCAGGAGACAAAG TCAACATCTCCTG | GGGCTGGCAAGCCACGTTTGG TGGCGACTCCAGGAGACAAAG TCAACATCTCCTG | SEQ ID NO: 6304 |
| IGK_V_06-21_O_D10 | CTGTGACTCCAAAGGAGAA AGTCACCATCACCTG | GGGCTGGCAAGCCACGTTTGG TGCTGTGACTCCAAAGGAGAA AGTCACCATCACCTG | SEQ ID NO: 6305 |
| IGK_V_6D-41_F_D10 | ACTCCAGGGGAGAAAGTCA CCATCACCTG | GGGCTGGCAAGCCACGTTTGG TGACTCCAGGGGAGAAAGTCA CCATCACCTG | SEQ ID NO: 6306 |
| IGK_V_07-03_P_D10 | CAGGACAGAGGGCCACCAT CACCTG | GGGCTGGCAAGCCACGTTTGG TGCAGGACAGAGGGCCACCAT CACCTG | SEQ ID NO: 6307 |
| IGL_V_R1-20_P_D10 | GCAGGACACTCACTCCCCC ACCTG | GGGCTGGCAAGCCACGTTTGG TGGCAGGACACTCACTCCCCC ACCTG | SEQ ID NO: 6308 |
| IGL_V_R1-63_P_D10 | TGGGCCAGAGGGTCACCAT CTCCTG | GGGCTGGCAAGCCACGTTTGG TGTGGGCCAGAGGGTCACCAT CTCCTG | SEQ ID NO: 6309 |
| IGL_V_R1-68_P_D10 | GGGCAGGTGGGTACCAGCT CCTG | GGGCTGGCAAGCCACGTTTGG TGGGGCAGGTGGGTACCAGCT CCTG | SEQ ID NO: 6310 |
| IGL_V_R1-70_P_D10 | CGTGGGACAGAAGGTCACC CTCTCCTG | GGGCTGGCAAGCCACGTTTGG TGCGTGGGACAGAAGGTCACC CTCTCCTG | SEQ ID NO: 6311 |
| IGL_V_R4-59_P_D10 | TCTCTGGGAGCATCTTCCA GACTCACCTG | GGGCTGGCAAGCCACGTTTGG TGTCTCTGGGAGCATCTTCCA GACTCACCTG | SEQ ID NO: 6312 |
| IGL_V_R4-64_P_D10 | CACCTCCGGATCAGCCAGA CTCTCCTG | GGGCTGGCAAGCCACGTTTGG TGCACCTCCGGATCAGCCAGA CTCTCCTG | SEQ ID NO: 6313 |
| IGL_V_R4-65_P_D10 | CCGGGAGCATGAGCCAGAC TTACCTG | GGGCTGGCAAGCCACGTTTGG TGCCGGGAGCATGAGCCAGAC TTACCTG | SEQ ID NO: 6314 |
| IGL_V_R4-66-1_P_D10 | CTCTGCACATCTGAGAAAT GCTATAAGACTTCCCTG | GGGCTGGCAAGCCACGTTTGG TGCTCTGCACATCTGAGAAAT GCTATAAGACTTCCCTG | SEQ ID NO: 6315 |
| IGL_V_R5-58_P_D10 | TGTGGGAGCCTCGGTCAAG CTTACCTC | GGGCTGGCAAGCCACGTTTGG TGTGTGGGAGCCTCGGTCAAG CTTACCTC | SEQ ID NO: 6316 |

| INFORMAL SEQUENCE LISTING | | | |
|---|---|---|---|
| IGL_V_01-36_F_D10 | CCCAGGCAGAGGGTCACCA TCTCCTG | GGGCTGGCAAGCCACGTTTGG TGCCCAGGCAGAGGGTCACCA TCTCCTG | SEQ ID NO: 6317 |
| IGL_V_01-40_F_D10 | CCAGGGCAGAGGGTCACCA TCTCCTG | GGGCTGGCAAGCCACGTTTGG TGCCAGGGCAGAGGGTCACCA TCTCCTG | SEQ ID NO: 6318 |
| IGL_V_01-44_F_D10 | CCGGGCAGAGGGTCACCAT CTCTTG | GGGCTGGCAAGCCACGTTTGG TGCCGGGCAGAGGGTCACCAT CTCTTG | SEQ ID NO: 6319 |
| IGL_V_01-51_F_D10 | CCCCAGGACAGAAGGTCAC CATCTCCTG | GGGCTGGCAAGCCACGTTTGG TGCCCCAGGACAGAAGGTCAC CATCTCCTG | SEQ ID NO: 6320 |
| IGL_V_01-62_P_D10 | CCACAAGGCAGAGGCTCAC TGTCTCCTG | GGGCTGGCAAGCCACGTTTGG TGCCACAAGGCAGAGGCTCAC TGTCTCCTG | SEQ ID NO: 6321 |
| IGL_V_02-08_F_D10 | GTCCTGGACAGTCAGTC ACCATCTCCTG | GGGCTGGCAAGCCACGTTTGG TGGTCTCCTGGACAGTCAGTC ACCATCTCCTG | SEQ ID NO: 6322 |
| IGL_V_02-14_F_D10 | GTCCTGGACAGTCGATC ACCATCTCCTG | GGGCTGGCAAGCCACGTTTGG TGGTCTCCTGGACAGTCGATC ACCATCTCCTG | SEQ ID NO: 6323 |
| IGL_V_02-33_O_D10 | TCCTGGACAGTCGGTCACC ATCTCCTG | GGGCTGGCAAGCCACGTTTGG TGTCCTGGACAGTCGGTCACC ATCTCCTG | SEQ ID NO: 6324 |
| IGL_V_02-34_P_D10 | CTGGGACTTGGGGTAAACA GTCACCATCTTCTG | GGGCTGGCAAGCCACGTTTGG TGCTGGGACTTGGGGTAAACA GTCACCATCTTCTG | SEQ ID NO: 6325 |
| IGL_V_03-01_F_D10 | CCAGGACAGACAGCCAGCA TCACCTG | GGGCTGGCAAGCCACGTTTGG TGCCAGGACAGACAGCCAGCA TCACCTG | SEQ ID NO: 6326 |
| IGL_V_03-02_P_D10 | CTTTGGGACGTACGGCCAG GATCATCTG | GGGCTGGCAAGCCACGTTTGG TGCTTTGGGACAGATGGCCAG GATCATCTG | SEQ ID NO: 6327 |
| IGL_V_03-04_P_D10 | CTTTGGGACAGATGGCCAG GATCACCTG | GGGCTGGCAAGCCACGTTTGG TGCTTTGGGACAGATGGCCAG GATCACCTG | SEQ ID NO: 6328 |
| IGL_V_03-06_P_D10 | CCAGGACAGGCAGCCATGA TCACCTG | GGGCTGGCAAGCCACGTTTGG TGCCAGGACAGGCAGCCATGA TCACCTG | SEQ ID NO: 6329 |
| IGL_V_03-07_P_D10 | TGGGACAGAGGGCCAGGAT CACCTA | GGGCTGGCAAGCCACGTTTGG TGTGGGACAGAGGGCCAGGAT CACCTA | SEQ ID NO: 6330 |
| IGL_V_03-09_FP_D10 | GGGACAGGCGGCCAGGATT ACCTG | GGGCTGGCAAGCCACGTTTGG TGGGGACAGGCGGCCAGGATT ACCTG | SEQ ID NO: 6331 |
| IGL_V_03-10_F_D10 | CCAGGACAAACGGCCAGGA TCACCTG | GGGCTGGCAAGCCACGTTTGG TGCCAGGACAAACGGCCAGGA TCACCTG | SEQ ID NO: 6332 |
| IGL_V_03-12_F_D10 | CACAGCACAGATGGCCAGG ATCACCTG | GGGCTGGCAAGCCACGTTTGG TGCACAGCACAGATGGCCAGG ATCACCTG | SEQ ID NO: 6333 |
| IGL_V_03-13_P_D10 | CCAGGACAGACAGCCAGGA TCAGCTG | GGGCTGGCAAGCCACGTTTGG TGCCAGGACAGACAGCCAGGA TCAGCTG | SEQ ID NO: 6334 |
| IGL_V_03-15_P_D10 | CCCCAGGACAGATGACCAG GATCACCTG | GGGCTGGCAAGCCACGTTTGG TGCCCCAGGACAGATGACCAG GATCACCTG | SEQ ID NO: 6335 |

INFORMAL SEQUENCE LISTING

| | | | |
|---|---|---|---|
| IGL_V_03-16_F_D10 | CCCTAGGACAGATGGCCAGGATCACCTG | GGGCTGGCAAGCCACGTTTGGTGCCCTAGGACAGATGGCCAGGATCACCTG | SEQ ID NO: 6336 |
| IGL_V_03-17_P_D10 | GTGTCTGTGGACAGTCAGCAAGGGTAACCTG | GGGCTGGCAAGCCACGTTTGGTGGTGTCTGTGGACAGTCAGCAAGGGTAACCTG | SEQ ID NO: 6337 |
| IGL_V_03-19_F_D10 | GGCCTTGGGACAGACAGTCAGGATCACATG | GGGCTGGCAAGCCACGTTTGGTGGGCCTTGGGACAGACAGTCAGGATCACATG | SEQ ID NO: 6338 |
| IGL_V_03-21_F_D10 | CCCCAGGAAAGACGGCCAGGATTACCTG | GGGCTGGCAAGCCACGTTTGGTGCCCCAGGAAAGACGGCCAGGATTACCTG | SEQ ID NO: 6339 |
| IGL_V_03-22_FP_D10 | CCCAGGACAGAAAGCCAGGATCACCTG | GGGCTGGCAAGCCACGTTTGGTGCCCAGGACAGAAAGCCAGGATCACCTG | SEQ ID NO: 6340 |
| IGL_V_03-24_P_D10 | CAGTAGCTCCAGGACAGATGACTAGGATCACCTG | GGGCTGGCAAGCCACGTTTGGTGCAGTAGCTCCAGGACAGATGACTAGGATCACCTG | SEQ ID NO: 6341 |
| IGL_V_03-25_F_D10 | CAGGACAGACGGCCAGGATCACCTG | GGGCTGGCAAGCCACGTTTGGTGCAGGACAGACGGCCAGGATCACCTG | SEQ ID NO: 6342 |
| IGL_V_03-26_P_D10 | CCTGGGACAGTCAGCCAGGGTAACCTG | GGGCTGGCAAGCCACGTTTGGTGCCTGGGACAGTCAGCCAGGGTAACCTG | SEQ ID NO: 6343 |
| IGL_V_03-27_F_D10 | CGGGACAGACAGCCAGGATCACCTG | GGGCTGGCAAGCCACGTTTGGTGCGGGACAGACAGCCAGGATCACCTG | SEQ ID NO: 6344 |
| IGL_V_03-29_P_D10 | CCCAGGACAGACACCCAGGATCACCTG | GGGCTGGCAAGCCACGTTTGGTGCCCAGGACAGACACCCAGGATCACCTG | SEQ ID NO: 6345 |
| IGL_V_03-30_P_D10 | CCCCATTACAGATGGCCAGGATCACCTG | GGGCTGGCAAGCCACGTTTGGTGCCCCATTACAGATGGCCAGGATCACCTG | SEQ ID NO: 6346 |
| IGL_V_03-31_P_D10 | GCCTTGGGATAGACAGCCAGGATCACCTG | GGGCTGGCAAGCCACGTTTGGTGGCCTTGGGATAGACAGCCAGGATCACCTG | SEQ ID NO: 6347 |
| IGL_V_03-32_O_D10 | CCTTGGGACAAATGGCCAGGATCACCTG | GGGCTGGCAAGCCACGTTTGGTGCCTTGGGACAAATGGCCAGGATCACCTG | SEQ ID NO: 6348 |
| IGL_V_04-03_F_D10 | CTGGGAGCCTCGATCAAGCTCACCTG | GGGCTGGCAAGCCACGTTTGGTGCTGGGAGCCTCGATCAAGCTCACCTG | SEQ ID NO: 6349 |
| IGL_V_04-60_F_D10 | CCTGGGATCCTCGGTCAAGCTCACCTG | GGGCTGGCAAGCCACGTTTGGTGCCTGGGATCCTCGGTCAAGCTCACCTG | SEQ ID NO: 6350 |
| IGL_V_04-69_F_D10 | GGGAGCCTCGGTCAAGCTCACCTG | GGGCTGGCAAGCCACGTTTGGTGGGGAGCCTCGGTCAAGCTCACCTG | SEQ ID NO: 6351 |
| IGL_V_05-37_F_D10 | TCCTGGAGAATCCGCCAGACTCACCTG | GGGCTGGCAAGCCACGTTTGGTGTCCTGGAGCATCAGCCAGACTCACCTG | SEQ ID NO: 6352 |
| IGL_V_05-39_F_D10 | TCTCCTGGAGCATCAGCCAGATTCACCTG | GGGCTGGCAAGCCACGTTTGGTGTCTCCTGGAGCATCAGCCAGATTCACCTG | SEQ ID NO: 6353 |
| IGL_V_05-45_F_D10 | TCCTGGAGCATCAGCCAGTCTCACCTG | GGGCTGGCAAGCCACGTTTGGTGTCCTGGAGCATCAGCCAGTCTCACCTG | SEQ ID NO: 6354 |

-continued

INFORMAL SEQUENCE LISTING

| | | | |
|---|---|---|---|
| IGL_V_05-48_O_D10 | TCCTGGAGCATCAGCCAGA CTCACCTG | GGGCTGGCAAGCCACGTTTGG TGTCCTGGAGCATCAGCCAGA CTCACCTG | SEQ ID NO: 6355 |
| IGL_V_05-52_F_D10 | GCATCTTCTGGAGCATCAG TCAGACTCACCTG | GGGCTGGCAAGCCACGTTTGG TGGCATCTTCTGGAGCATCAG TCAGACTCACCTG | SEQ ID NO: 6356 |
| IGL_V_06-57_F_D10 | TCCGGGGAAGACGGTAACC ATCTCCTG | GGGCTGGCAAGCCACGTTTGG TGTCCGGGGAAGACGGTAACC ATCTCCTG | SEQ ID NO: 6357 |
| IGL_V_07-35_P_D10 | CCCAGGAGGGACAGTCACT CTCACCTA | GGGCTGGCAAGCCACGTTTGG TGCCCAGGAGGGACAGTCACT CTCACCTA | SEQ ID NO: 6358 |
| IGL_V_07-43_F_D10 | CCCAGGAGGGACAGTCACT CTCACCTG | GGGCTGGCAAGCCACGTTTGG TGCCCAGGAGGGACAGTCACT CTCACCTG | SEQ ID NO: 6359 |
| IGL_V_08-61_F_D10 | CCCCTGGAGGGACAGTCAC ACTCACTTG | GGGCTGGCAAGCCACGTTTGG TGCCCCTGGAGGGACAGTCAC ACTCACTTG | SEQ ID NO: 6360 |
| IGL_V_09-49_F_D10 | TGGGAGCCTCGGTCACACT CACCTG | GGGCTGGCAAGCCACGTTTGG TGTGGGAGCCTCGGTCACACT CACCTG | SEQ ID NO: 6361 |
| IGL_V_10-54_F_D10 | CTTGAGACAGACCGCCACA CTCACCTG | GGGCTGGCAAGCCACGTTTGG TGCTTGAGACAGACCGCCACA CTCACCTG | SEQ ID NO: 6362 |
| IGK_J_01_F_D10 | TTCTACTCACGTTTGATTT CCACCTTGGTCCC | CCGGGAGCTGCATGTGTCAGA GGTTCTACTCACGTTTGATTT CCACCTTGGTCCC | SEQ ID NO: 6363 |
| IGK_J_02_F_D10 | AAGTACTTACGTTTGATCT CCAGCTTGGTCCC | CCGGGAGCTGCATGTGTCAGA GGAAGTACTTACGTTTGATCT CCAGCTTGGTCCC | SEQ ID NO: 6364 |
| IGK_J_03_F_D10 | ACAGATGTACTTACGTTTG ATATCCACTTTGGTCCC | CCGGGAGCTGCATGTGTCAGA GGACAGATGTACTTACGTTTG ATATCCACTTTGGTCCC | SEQ ID NO: 6365 |
| IGK_J_04_F_D10 | CACTTACGTTTGATCTCCA CCTTGGTCCC | CCGGGAGCTGCATGTGTCAGA GGCACTTACGTTTGATCTCCA CCTTGGTCCC | SEQ ID NO: 6366 |
| IGK_J_05_F_D10 | GAAAAATTACTTACGTTTA ATCTCCAGTCGTGTCCC | CCGGGAGCTGCATGTGTCAGA GGGAAAAATTACTTACGTTTA ATCTCCAGTCGTGTCCC | SEQ ID NO: 6367 |
| IGL_J_01_F_D10 | CTTACCTAGGACGGTGACC TTGGTCCC | CCGGGAGCTGCATGTGTCAGA GGCTTACCTAGGACGGTGACC TTGGTCCC | SEQ ID NO: 6368 |
| IGL_J_02_F_D10 | ACCTAGGACGGTCAGCTTG GTCCC | CCGGGAGCTGCATGTGTCAGA GGACCTAGGACGGTCAGCTTG GTCCC | SEQ ID NO: 6369 |
| IGL_J_04_O_D10 | AAGAAGAGACTCATCTAAA ATGATCAGCTGGGTTCC | CCGGGAGCTGCATGTGTCAGA GGAAGAAGAGACTCATCTAAA ATGATCAGCTGGGTTCC | SEQ ID NO: 6370 |
| IGL_J_05_O_D10 | ATCTAGGACGGTCAGCTCC GTCCC | CCGGGAGCTGCATGTGTCAGA GGATCTAGGACGGTCAGCTCC GTCCC | SEQ ID NO: 6371 |
| IGL_J_06_F_D10 | GAGGACGGTCACCTTGGTG CC | CCGGGAGCTGCATGTGTCAGA GGGAGGACGGTCACCTTGGTG CC | SEQ ID NO: 6372 |
| IGL_J_07_F_D10 | AGGACGGTCAGCTGGGTGC C | CCGGGAGCTGCATGTGTCAGA GGAGGACGGTCAGCTGGGTGC C | SEQ ID NO: 6373 |

-continued

| INFORMAL SEQUENCE LISTING | | | |
|---|---|---|---|
| IGK_J_del_F_D10 | CTGCAGACTCATGAGGAGT CGCCC | CCGGGAGCTGCATGTGTCAGA GGCTGCAGACTCATGAGGAGT CGCCC | SEQ ID NO: 6374 |

SEQUENCE LISTING (6616 sequences)

SEQ ID NO: 1 - DNA, 495 bp, Artificial Sequence
  source: /note="Description of Artificial Sequence: Synthetic polynucleotide"
gcctccctcgcgccatcagagagtgtcacgtgtgtctgtggacccacttttccctgtgacggatctgcaaaagaacctgaaaaatgtcttacctacaactgtgagtctggtgccttgtccaaagaaagcttcagtgtcgacagagtgtcacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagaagagtgtcacgtgtgtctgagcgggctggcaaggc

SEQ ID NO: 2 - DNA, 495 bp, Artificial Sequence
  source: /note="Description of Artificial Sequence: Synthetic polynucleotide"
gcctccctcgcgccatcaggttccgaaacgtgtgtatttcccaggacagagtcctccctcatcgcacccctcctagagacccccagccttacctacaacggttaacctggtccccgaaccgaaggtgtagccatagtcgacgttccgaaacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagttccgaaacgtgtgtctgagcgggctggcaaggc

SEQ ID NO: 3 - DNA, 495 bp, Artificial Sequence
  source: /note="Description of Artificial Sequence: Synthetic polynucleotide"
gcctccctcgcgccatcagcgttacttacgtgtgtctggattccagcccctttttgcaagttcccagctgtccagccttgacttactcacctacaacagtgagccaacttccctctccaaaatatatggtgtttcgtcgaccgttacttacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacgttacttacgtgtgtctgagcgggctggcaaggc

SEQ ID NO: 4 - DNA, 495 bp, Artificial Sequence
  source: /note="Description of Artificial Sequence: Synthetic polynucleotide"
gcctccctcgcgccatcagtaggagacacgtgtgtctcctggaactccgaccttatgatacactatcccgaaagaagtcttttacatacccaagacagagagctgggttccactgccaaaaaacagtttttcattgtcgactaggagacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagataggagacacgtgtgtctgagcgggctggcaaggc

SEQ ID NO: 5 - DNA, 495 bp, Artificial Sequence
  source: /note="Description of Artificial Sequence: Synthetic polynucleotide"
gcctccctcgcgccatcaggacactctacgtgtgtagagaactctgccttcaagggacaatggccataccaccctgattctgcaacttacctaggatggagagtcgagtcccatcaccaaaatgctggggctgatgtcgacgacactctacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagacactctacgtgtgtctgagcgggctggcaaggc

SEQ ID NO: 6 - DNA, 495 bp, Artificial Sequence
  source: /note="Description of Artificial Sequence: Synthetic polynucleotide"
gcctccctcgcgccatcagttcggaacacgtgtgtatcattgcagtcaaacccaggcacccccgagtcaagagtggagcccccatacctgtcacagtgagcctggtcccgttcccaaagtggaggggtgaattatgtcgacttcggaacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagattcggaacacgtgtgtctgagcgggctggcaaggc

SEQ ID NO: 7 - DNA, 495 bp, Artificial Sequence
  source: /note="Description of Artificial Sequence: Synthetic polynucleotide"
gcctccctcgcgccatcagaagtaacgacgtgtgtgggtcgtgcaggctgggctgctcaccctctctcccacctggagcccccttcttacctagcacggtgagccgtgtccctggcccgaagaactgctcattgtgtcgacaagtaacgacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagaaagtaacgacgtgtgtctgagcgggctggcaaggc

SEQ ID NO: 8 - DNA, 495 bp, Artificial Sequence
  source: /note="Description of Artificial Sequence: Synthetic polynucleotide"
gcctccctcgcgccatcaggtctcctaacgtgtgtcctctgcccatcccgccctctcggagctctccggagccccaaccgcctccttacccagtacggtcagcctagagccttctccaaaaaacagctccccggtgtcgacgtctcctaacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagtctcctaacgtgtgtctgagcgggctggcaaggc

SEQ ID NO: 9 - DNA, 495 bp, Artificial Sequence
  source: /note="Description of Artificial Sequence: Synthetic polynucleotide"
gcctccctcgcgccatcaggtagacacacgtgtgtgcgtcccggggcgccccctccccagttccggggcttcagcgggagcccccgcttaccgagcactgtcagccgggtgcctgggccaaaatactgcgtatctgtcgacgtagacacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagtagacacacgtgtgtctgagcgggctggcaaggc

SEQ ID NO: 10 - DNA, 495 bp, Artificial Sequence
  source: /note="Description of Artificial Sequence: Synthetic polynucleotide"
gcctccctcgcgccatcagcactgtacacgtgtgtcgcacaaaaacccgagcgcagtctcgtccccggtcccccggcggccccagcttacccagcactgagagccgggtcccggcgccgaagtactgaatgttttgtcgaccactgtacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacactgtacacgtgtgtctgagcgggctggcaaggc

SEQ ID NO: 11 - DNA, 495 bp, Artificial Sequence
  source: /note="Description of Artificial Sequence: Synthetic polynucleotide"
gcctccctcgcgccatcaggatgatccacgtgtgtccccgcaaaaaccagacccaagccgcccgcgcccgcgccccagcagcccgcgctcaccgagcaccaggagccgcgtgcctggcccgaagtactgggtctcgtcgacgatgatccacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagatgatccacgtgtgtctgagcgggctggcaaggc

SEQ ID NO: 12 - DNA, 495 bp, Artificial Sequence
  source: /note="Description of Artificial Sequence: Synthetic polynucleotide"
gcctccctcgcgccatcagcgccaataacgtgtgtccgccgccttccacctgaatcccgccgcccgggtggtcccgcgaaaactcacccagcacggtcagcctgctgccggccccgaaagtcaggacgttggcccgtcgaccgccaataacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacgccaataacgtgtgtctgagcgggctggcaaggc

SEQ ID NO: 13 - DNA, 495 bp, Artificial Sequence
  source: /note="Description of Artificial Sequence: Synthetic polynucleotide"
gcctccctcgcgccatcagtcaagcctacgtgtgtccaccctccgactccggggaccgaggggctggaaggtggggagacgcccgaatctcacctgtgaccgtgagcctggtgcccggcccgaagtactgctcgtgtcgactcaagcctacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagatcaagcctacgtgtgtctgagcgggctggcaaggc

SEQ ID NO: 14 - DNA, 495 bp, Artificial Sequence
  source: /note="Description of Artificial Sequence: Synthetic polynucleotide"
gcctccctcgcgccatcagagagtgtctccgtctactgtggacccacttttccctgtgacggatctgcaaaagaacctgaaaaatgtcttacctacaactgtgagtctggtgccttgtccaaagaaagcttcagtgtcgacagagtgtctccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagaagagtgtctccgtctactgagcgggctggcaaggc

SEQ ID NO: 15 - DNA, 495 bp, Artificial Sequence
  source: /note="Description of Artificial Sequence: Synthetic polynucleotide"
gcctccctcgcgccatcaggttccgaatccgtctaatttcccaggacagagtcctccctcatcgcacccctcctagagacccccagccttacctacaacggttaacctggtccccgaaccgaaggtgtagccatagtcgacgttccgaatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagttccgaatccgtctactgagcgggctggcaaggc

SEQ ID NO: 16 - DNA, 495 bp, Artificial Sequence
  source: /note="Description of Artificial Sequence: Synthetic polynucleotide"
gcctccctcgcgccatcagcgttactttccgtctactggattccagcccctttttgcaagttcccagctgtccagccttgacttactcacctacaacagtgagccaacttccctctccaaaatatatggtgtttcgtcgaccgttactttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacgttactttccgtctactgagcgggctggcaaggc

SEQ ID NO: 17 - DNA, 495 bp, Artificial Sequence
  source: /note="Description of Artificial Sequence: Synthetic polynucleotide"
gcctccctcgcgccatcagtaggagactccgtctactcctggaactccgaccttatgatacactatcccgaaagaagtcttttacatacccaagacagagagctgggttccactgccaaaaaacagtttttcattgtcgactaggagactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagataggagactccgtctactgagcgggctggcaaggc

SEQ ID NO: 18 - DNA, 495 bp, Artificial Sequence
  source: /note="Description of Artificial Sequence: Synthetic polynucleotide"
gcctccctcgcgccatcaggacactcttccgtctaagagaactctgccttcaagggacaatggccataccaccctgattctgcaacttacctaggatggagagtcgagtcccatcaccaaaatgctggggctgatgtcgacgacactcttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagacactcttccgtctactgagcgggctggcaaggc

SEQ ID NO: 19 - DNA, 495 bp, Artificial Sequence
  source: /note="Description of Artificial Sequence: Synthetic polynucleotide"
gcctccctcgcgccatcagttcggaactccgtctaatcattgcagtcaaacccaggcacccccgagtcaagagtggagcccccatacctgtcacagtgagcctggtcccgttcccaaagtggaggggtgaattatgtcgacttcggaactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagattcggaactccgtctactgagcgggctggcaaggc

SEQ ID NO: 20 - DNA, 495 bp, Artificial Sequence
  source: /note="Description of Artificial Sequence: Synthetic polynucleotide"
gcctccctcgcgccatcagaagtaacgtccgtctagggtcgtgcaggctgggctgctcaccctctctcccacctggagcccccttcttacctagcacggtgagccgtgtccctggcccgaagaactgctcattgtgtcgacaagtaacgtccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagaaagtaacgtccgtctactgagcgggctggcaaggc

SEQ ID NO: 21 - DNA, 495 bp, Artificial Sequence
  source: /note="Description of Artificial Sequence: Synthetic polynucleotide"
gcctccctcgcgccatcaggtctcctatccgtctacctctgcccatcccgccctctcggagctctccggagccccaaccgcctccttacccagtacggtcagcctagagccttctccaaaaaacagctccccggtgtcgacgtctcctatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagtctcctatccgtctactgagcgggctggcaaggc

SEQ ID NO: 22 - DNA, 495 bp, Artificial Sequence
  source: /note="Description of Artificial Sequence: Synthetic polynucleotide"
gcctccctcgcgccatcaggtagacactccgtctagcgtcccggggcgccccctccccagttccggggcttcagcgggagcccccgcttaccgagcactgtcagccgggtgcctgggccaaaatactgcgtatctgtcgacgtagacactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagtagacactccgtctactgagcgggctggcaaggc

SEQ ID NO: 23 - DNA, 495 bp, Artificial Sequence
  source: /note="Description of Artificial Sequence: Synthetic polynucleotide"
gcctccctcgcgccatcagcactgtactccgtctacgcacaaaaacccgagcgcagtctcgtccccggtcccccggcggccccagcttacccagcactgagagccgggtcccggcgccgaagtactgaatgttttgtcgaccactgtactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacactgtactccgtctactgagcgggctggcaaggc

SEQ ID NO: 24 - DNA, 495 bp, Artificial Sequence
  source: /note="Description of Artificial Sequence: Synthetic polynucleotide"
gcctccctcgcgccatcaggatgatcctccgtctaccccgcaaaaaccagacccaagccgcccgcgcccgcgccccagcagcccgcgctcaccgagcaccaggagccgcgtgcctggcccgaagtactgggtctcgtcgacgatgatcctccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagatgatcctccgtctactgagcgggctggcaaggc

SEQ ID NO: 25 - DNA, 495 bp, Artificial Sequence
  source: /note="Description of Artificial Sequence: Synthetic polynucleotide"
gcctccctcgcgccatcagcgccaatatccgtctaccgccgccttccacctgaatcccgccgcccgggtggtcccgcgaaaactcacccagcacggtcagcctgctgccggccccgaaagtcaggacgttggcccgtcgaccgccaatatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacgccaatatccgtctactgagcgggctggcaaggc

SEQ ID NO: 26 - DNA, 495 bp, Artificial Sequence
  source: /note="Description of Artificial Sequence: Synthetic polynucleotide"
gcctccctcgcgccatcagtcaagccttccgtctaccaccctccgactccggggaccgaggggctggaaggtggggagacgcccgaatctcacctgtgaccgtgagcctggtgcccggcccgaagtactgctcgtgtcgactcaagccttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagatcaagccttccgtctactgagcgggctggcaaggc

SEQ ID NO: 27 - DNA, 495 bp, Artificial Sequence
  source: /note="Description of Artificial Sequence: Synthetic polynucleotide"
gcctccctcgcgccatcagagagtgtcaagagctgctgtggacccacttttccctgtgacggatctgcaaaagaacctgaaaaatgtcttacctacaactgtgagtctggtgccttgtccaaagaaagcttcagtgtcgacagagtgtcaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaaagagtgtcaagagctgctgagcgggctggcaaggc

SEQ ID NO: 28 - DNA, 495 bp, Artificial Sequence
  source: /note="Description of Artificial Sequence: Synthetic polynucleotide"
gcctccctcgcgccatcaggttccgaaaagagctgatttcccaggacagagtcctccctcatcgcacccctcctagagacccccagccttacctacaacggttaacctggtccccgaaccgaaggtgtagccatagtcgacgttccgaaaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagttccgaaaagagctgctgagcgggctggcaaggc

SEQ ID NO: 29 - DNA, 495 bp, Artificial Sequence
  source: /note="Description of Artificial Sequence: Synthetic polynucleotide"
gcctccctcgcgccatcagcgttacttaagagctgctggattccagcccctttttgcaagttcccagctgtccagccttgacttactcacctacaacagtgagccaacttccctctccaaaatatatggtgtttcgtcgaccgttacttaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacgttacttaagagctgctgagcgggctggcaaggc

SEQ ID NO: 30 - DNA, 495 bp, Artificial Sequence
  source: /note="Description of Artificial Sequence: Synthetic polynucleotide"
gcctccctcgcgccatcagtaggagacaagagctgctcctggaactccgaccttatgatacactatcccgaaagaagtcttttacatacccaagacagagagctgggttccactgccaaaaaacagtttttcattgtcgactaggagacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaataggagacaagagctgctgagcgggctggcaaggc

SEQ ID NO: 31 - DNA, 495 bp, Artificial Sequence
  source: /note="Description of Artificial Sequence: Synthetic polynucleotide"
gcctccctcgcgccatcaggacactctaagagctgagagaactctgccttcaagggacaatggccataccaccctgattctgcaacttacctaggatggagagtcgagtcccatcaccaaaatgctggggctgatgtcgacgacactctaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagacactctaagagctgctgagcgggctggcaaggc

SEQ ID NO: 32 - DNA, 495 bp, Artificial Sequence
  source: /note="Description of Artificial Sequence: Synthetic polynucleotide"
gcctccctcgcgccatcagttcggaacaagagctgatcattgcagtcaaacccaggcacccccgagtcaagagtggagcccccatacctgtcacagtgagcctggtcccgttcccaaagtggaggggtgaattatgtcgacttcggaacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaattcggaacaagagctgctgagcgggctggcaaggc

SEQ ID NO: 33 - DNA, 495 bp, Artificial Sequence
  source: /note="Description of Artificial Sequence: Synthetic polynucleotide"
gcctccctcgcgccatcagaagtaacgaagagctggggtcgtgcaggctgggctgctcaccctctctcccacctggagcccccttcttacctagcacggtgagccgtgtccctggcccgaagaactgctcattgtgtcgacaagtaacgaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaaaagtaacgaagagctgctgagcgggctggcaaggc

SEQ ID NO: 34 - DNA, 495 bp, Artificial Sequence
  source: /note="Description of Artificial Sequence: Synthetic polynucleotide"
gcctccctcgcgccatcaggtctcctaaagagctgcctctgcccatcccgccctctcggagctctccggagccccaaccgcctccttacccagtacggtcagcctagagccttctccaaaaaacagctccccggtgtcgacgtctcctaaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagtctcctaaagagctgctgagcgggctggcaaggc

SEQ ID NO: 35 - DNA, 495 bp, Artificial Sequence
  source: /note="Description of Artificial Sequence: Synthetic polynucleotide"
gcctccctcgcgccatcaggtagacacaagagctggcgtcccggggcgccccctccccagttccggggcttcagcgggagcccccgcttaccgagcactgtcagccgggtgcctgggccaaaatactgcgtatctgtcgacgtagacacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagtagacacaagagctgctgagcgggctggcaaggc

SEQ ID NO: 36 - DNA, 495 bp, Artificial Sequence
  source: /note="Description of Artificial Sequence: Synthetic polynucleotide"
gcctccctcgcgccatcagcactgtacaagagctgcgcacaaaaacccgagcgcagtctcgtccccggtcccccggcggccccagcttacccagcactgagagccgggtcccggcgccgaagtactgaatgttttgtcgaccactgtacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacactgtacaagagctgctgagcgggctggcaaggc

SEQ ID NO: 37 - DNA, 495 bp, Artificial Sequence
  source: /note="Description of Artificial Sequence: Synthetic polynucleotide"
gcctccctcgcgccatcaggatgatccaagagctgccccgcaaaaaccagacccaagccgcccgcgcccgcgccccagcagcccgcgctcaccgagcaccaggagccgcgtgcctggcccgaagtactgggtctcgtcgacgatgatccaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagatgatccaagagctgctgagcgggctggcaaggc

SEQ ID NO: 38 - DNA, 495 bp, Artificial Sequence
  source: /note="Description of Artificial Sequence: Synthetic polynucleotide"
gcctccctcgcgccatcagcgccaataaagagctgccgccgccttccacctgaatcccgccgcccgggtggtcccgcgaaaactcacccagcacggtcagcctgctgccggccccgaaagtcaggacgttggcccgtcgaccgccaataaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacgccaataaagagctgctgagcgggctggcaaggc

SEQ ID NO: 39 - DNA, 495 bp, Artificial Sequence
  source: /note="Description of Artificial Sequence: Synthetic polynucleotide"
gcctccctcgcgccatcagtcaagcctaagagctgccaccctccgactccggggaccgaggggctggaaggtggggagacgcccgaatctcacctgtgaccgtgagcctggtgcccggcccgaagtactgctcgtgtcgactcaagcctaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaatcaagcctaagagctgctgagcgggctggcaaggc

SEQ ID NO: 40 - DNA, 495 bp, Artificial Sequence
  source: /note="Description of Artificial Sequence: Synthetic polynucleotide"
gcctccctcgcgccatcagagagtgtctatcgctcctgtggacccacttttccctgtgacggatctgcaaaagaacctgaaaaatgtcttacctacaactgtgagtctggtgccttgtccaaagaaagcttcagtgtcgacagagtgtctatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaaagagtgtctatcgctcctgagcgggctggcaaggc

SEQ ID NO: 41 - DNA, 495 bp, Artificial Sequence
  source: /note="Description of Artificial Sequence: Synthetic polynucleotide"
gcctccctcgcgccatcaggttccgaatatcgctcatttcccaggacagagtcctccctcatcgcacccctcctagagacccccagccttacctacaacggttaacctggtccccgaaccgaaggtgtagccatagtcgacgttccgaatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagttccgaatatcgctcctgagcgggctggcaaggc

SEQ ID NO: 42 - DNA, 495 bp, Artificial Sequence
  source: /note="Description of Artificial Sequence: Synthetic polynucleotide"
gcctccctcgcgccatcagcgttactttatcgctcctggattccagcccctttttgcaagttcccagctgtccagccttgacttactcacctacaacagtgagccaacttccctctccaaaatatatggtgtttcgtcgaccgttactttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacgttactttatcgctcctgagcgggctggcaaggc

SEQ ID NO: 43 - DNA, 495 bp, Artificial Sequence
  source: /note="Description of Artificial Sequence: Synthetic polynucleotide"
gcctccctcgcgccatcagtaggagactatcgctcctcctggaactccgaccttatgatacactatcccgaaagaagtcttttacatacccaagacagagagctgggttccactgccaaaaaacagtttttcattgtcgactaggagactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaataggagactatcgctcctgagcgggctggcaaggc

SEQ ID NO: 44 - DNA, 495 bp, Artificial Sequence
  source: /note="Description of Artificial Sequence: Synthetic polynucleotide"
gcctccctcgcgccatcaggacactcttatcgctcagagaactctgccttcaagggacaatggccataccaccctgattctgcaacttacctaggatggagagtcgagtcccatcaccaaaatgctggggctgatgtcgacgacactcttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagacactcttatcgctcctgagcgggctggcaaggc

SEQ ID NO: 45 - DNA, 495 bp, Artificial Sequence
  source: /note="Description of Artificial Sequence: Synthetic polynucleotide"
gcctccctcgcgccatcagttcggaactatcgctcatcattgcagtcaaacccaggcacccccgagtcaagagtggagcccccatacctgtcacagtgagcctggtcccgttcccaaagtggaggggtgaattatgtcgacttcggaactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaattcggaactatcgctcctgagcgggctggcaaggc

SEQ ID NO: 46 - DNA, 495 bp, Artificial Sequence
  source: /note="Description of Artificial Sequence: Synthetic polynucleotide"
gcctccctcgcgccatcagaagtaacgtatcgctcgggtcgtgcaggctgggctgctcaccctctctcccacctggagcccccttcttacctagcacggtgagccgtgtccctggcccgaagaactgctcattgtgtcgacaagtaacgtatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaaaagtaacgtatcgctcctgagcgggctggcaaggc

SEQ ID NO: 47 - DNA, 495 bp, Artificial Sequence
  source: /note="Description of Artificial Sequence: Synthetic polynucleotide"
gcctccctcgcgccatcaggtctcctatatcgctccctctgcccatcccgccctctcggagctctccggagccccaaccgcctccttacccagtacggtcagcctagagccttctccaaaaaacagctccccggtgtcgacgtctcctatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagtctcctatatcgctcctgagcgggctggcaaggc

SEQ ID NO: 48 - DNA, 495 bp, Artificial Sequence
  source: /note="Description of Artificial Sequence: Synthetic polynucleotide"
gcctccctcgcgccatcaggtagacactatcgctcgcgtcccggggcgccccctccccagttccggggcttcagcgggagcccccgcttaccgagcactgtcagccgggtgcctgggccaaaatactgcgtatctgtcgacgtagacactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagtagacactatcgctcctgagcgggctggcaaggc

SEQ ID NO: 49 - DNA, 495 bp, Artificial Sequence
  source: /note="Description of Artificial Sequence: Synthetic polynucleotide"
gcctccctcgcgccatcagcactgtactatcgctccgcacaaaaacccgagcgcagtctcgtccccggtcccccggcggccccagcttacccagcactgagagccgggtcccggcgccgaagtactgaatgttttgtcgaccactgtactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacactgtactatcgctcctgagcgggctggcaaggc

SEQ ID NO: 50 - DNA, 495 bp, Artificial Sequence
  source: /note="Description of Artificial Sequence: Synthetic polynucleotide"
gcctccctcgcgccatcaggatgatcctatcgctcccccgcaaaaaccagacccaagccgcccgcgcccgcgccccagcagcccgcgctcaccgagcaccaggagccgcgtgcctggcccgaagtactgggtctcgtcgacgatgatcctatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagatgatcctatcgctcctgagcgggctggcaaggc

SEQ ID NO: 51 - DNA, 495 bp, Artificial Sequence
  source: /note="Description of Artificial Sequence: Synthetic polynucleotide"
gcctccctcgcgccatcagcgccaatatatcgctcccgccgccttccacctgaatcccgccgcccgggtggtcccgcgaaaactcacccagcacggtcagcctgctgccggccccgaaagtcaggacgttggcccgtcgaccgccaatatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacgccaatatatcgctcctgagcgggctggcaaggc

SEQ ID NO: 52 - DNA, 495 bp, Artificial Sequence
  source: /note="Description of Artificial Sequence: Synthetic polynucleotide"
gcctccctcgcgccatcagtcaagccttatcgctcccaccctccgactccggggaccgaggggctggaaggtggggagacgcccgaatctcacctgtgaccgtgagcctggtgcccggcccgaagtactgctcgtgtcgactcaagccttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaatcaagccttatcgctcctgagcgggctggcaaggc

SEQ ID NO: 53 - DNA, 495 bp, Artificial Sequence
  source: /note="Description of Artificial Sequence: Synthetic polynucleotide"
gcctccctcgcgccatcagagagtgtctcagatgcctgtggacccacttttccctgtgacggatctgcaaaagaacctgaaaaatgtcttacctacaactgtgagtctggtgccttgtccaaagaaagcttcagtgtcgacagagtgtctcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggaagagtgtctcagatgcctgagcgggctggcaaggc

SEQ ID NO: 54 - DNA, 495 bp, Artificial Sequence
  source: /note="Description of Artificial Sequence: Synthetic polynucleotide"
gcctccctcgcgccatcaggttccgaatcagatgcatttcccaggacagagtcctccctcatcgcacccctcctagagacccccagccttacctacaacggttaacctggtccccgaaccgaaggtgtagccatagtcgacgttccgaatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagttccgaatcagatgcctgagcgggctggcaaggc

SEQ ID NO: 55 - DNA, 495 bp, Artificial Sequence
  source: /note="Description of Artificial Sequence: Synthetic polynucleotide"
gcctccctcgcgccatcagcgttactttcagatgcctggattccagcccctttttgcaagttcccagctgtccagccttgacttactcacctacaacagtgagccaacttccctctccaaaatatatggtgtttcgtcgaccgttactttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacgttactttcagatgcctgagcgggctggcaaggc

SEQ ID NO: 56 - DNA, 495 bp, Artificial Sequence
  source: /note="Description of Artificial Sequence: Synthetic polynucleotide"
gcctccctcgcgccatcagtaggagactcagatgcctcctggaactccgaccttatgatacactatcccgaaagaagtcttttacatacccaagacagagagctgggttccactgccaaaaaacagtttttcattgtcgactaggagactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggataggagactcagatgcctgagcgggctggcaaggc

SEQ ID NO: 57 - DNA, 495 bp, Artificial Sequence
  source: /note="Description of Artificial Sequence: Synthetic polynucleotide"
gcctccctcgcgccatcaggacactcttcagatgcagagaactctgccttcaagggacaatggccataccaccctgattctgcaacttacctaggatggagagtcgagtcccatcaccaaaatgctggggctgatgtcgacgacactcttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagacactcttcagatgcctgagcgggctggcaaggc

SEQ ID NO: 58 - DNA, 495 bp, Artificial Sequence
  source: /note="Description of Artificial Sequence: Synthetic polynucleotide"
gcctccctcgcgccatcagttcggaactcagatgcatcattgcagtcaaacccaggcacccccgagtcaagagtggagcccccatacctgtcacagtgagcctggtcccgttcccaaagtggaggggtgaattatgtcgacttcggaactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggattcggaactcagatgcctgagcgggctggcaaggc

SEQ ID NO: 59 - DNA, 495 bp, Artificial Sequence
  source: /note="Description of Artificial Sequence: Synthetic polynucleotide"
gcctccctcgcgccatcagaagtaacgtcagatgcgggtcgtgcaggctgggctgctcaccctctctcccacctggagcccccttcttacctagcacggtgagccgtgtccctggcccgaagaactgctcattgtgtcgacaagtaacgtcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggaaagtaacgtcagatgcctgagcgggctggcaaggc

SEQ ID NO: 60 - DNA, 495 bp, Artificial Sequence
  source: /note="Description of Artificial Sequence: Synthetic polynucleotide"
gcctccctcgcgccatcaggtctcctatcagatgccctctgcccatcccgccctctcggagctctccggagccccaaccgcctccttacccagtacggtcagcctagagccttctccaaaaaacagctccccggtgtcgacgtctcctatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagtctcctatcagatgcctgagcgggctggcaaggc

SEQ ID NO: 61 - DNA, 495 bp, Artificial Sequence
  source: /note="Description of Artificial Sequence: Synthetic polynucleotide"
gcctccctcgcgccatcaggtagacactcagatgcgcgtcccggggcgccccctccccagttccggggcttcagcgggagcccccgcttaccgagcactgtcagccgggtgcctgggccaaaatactgcgtatctgtcgacgtagacactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagtagacactcagatgcctgagcgggctggcaaggc

SEQ ID NO: 62 - DNA, 495 bp, Artificial Sequence
  source: /note="Description of Artificial Sequence: Synthetic polynucleotide"
gcctccctcgcgccatcagcactgtactcagatgccgcacaaaaacccgagcgcagtctcgtccccggtcccccggcggccccagcttacccagcactgagagccgggtcccggcgccgaagtactgaatgttttgtcgaccactgtactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacactgtactcagatgcctgagcgggctggcaaggc

SEQ ID NO: 63 - DNA, 495 bp, Artificial Sequence
  source: /note="Description of Artificial Sequence: Synthetic polynucleotide"
gcctccctcgcgccatcaggatgatcctcagatgcccccgcaaaaaccagacccaagccgcccgcgcccgcgccccagcagcccgcgctcaccgagcaccaggagccgcgtgcctggcccgaagtactgggtctcgtcgacgatgatcctcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagatgatcctcagatgcctgagcgggctggcaaggc

SEQ ID NO: 64 - DNA, 495 bp, Artificial Sequence
  source: /note="Description of Artificial Sequence: Synthetic polynucleotide"
gcctccctcgcgccatcagcgccaatatcagatgcccgccgccttccacctgaatcccgccgcccgggtggtcccgcgaaaactcacccagcacggtcagcctgctgccggccccgaaagtcaggacgttggcccgtcgaccgccaatatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacgccaatatcagatgcctgagcgggctggcaaggc

SEQ ID NO: 65 - DNA, 495 bp, Artificial Sequence
  source: /note="Description of Artificial Sequence: Synthetic polynucleotide"
gcctccctcgcgccatcagtcaagccttcagatgcccaccctccgactccggggaccgaggggctggaaggtggggagacgcccgaatctcacctgtgaccgtgagcctggtgcccggcccgaagtactgctcgtgtcgactcaagccttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggatcaagccttcagatgcctgagcgggctggcaaggc

SEQ ID NO: 66 - DNA, 495 bp, Artificial Sequence
  source: /note="Description of Artificial Sequence: Synthetic polynucleotide"
gcctccctcgcgccatcagagagtgtcgtgtagcactgtggacccacttttccctgtgacggatctgcaaaagaacctgaaaaatgtcttacctacaactgtgagtctggtgccttgtccaaagaaagcttcagtgtcgacagagtgtcgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggaagagtgtcgtgtagcactgagcgggctggcaaggc

SEQ ID NO: 67 - DNA, 495 bp, Artificial Sequence
  source: /note="Description of Artificial Sequence: Synthetic polynucleotide"
gcctccctcgcgccatcaggttccgaagtgtagcaatttcccaggacagagtcctccctcatcgcacccctcctagagacccccagccttacctacaacggttaacctggtccccgaaccgaaggtgtagccatagtcgacgttccgaagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagttccgaagtgtagcactgagcgggctggcaaggc

SEQ ID NO: 68 - DNA, 495 bp, Artificial Sequence
  source: /note="Description of Artificial Sequence: Synthetic polynucleotide"
gcctccctcgcgccatcagcgttacttgtgtagcactggattccagcccctttttgcaagttcccagctgtccagccttgacttactcacctacaacagtgagccaacttccctctccaaaatatatggtgtttcgtcgaccgttacttgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacgttacttgtgtagcactgagcgggctggcaaggc

SEQ ID NO: 69 - DNA, 495 bp, Artificial Sequence
  source: /note="Description of Artificial Sequence: Synthetic polynucleotide"
gcctccctcgcgccatcagtaggagacgtgtagcactcctggaactccgaccttatgatacactatcccgaaagaagtcttttacatacccaagacagagagctgggttccactgccaaaaaacagtttttcattgtcgactaggagacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggataggagacgtgtagcactgagcgggctggcaaggc

SEQ ID NO: 70 - DNA, 495 bp, Artificial Sequence
  source: /note="Description of Artificial Sequence: Synthetic polynucleotide"
gcctccctcgcgccatcaggacactctgtgtagcaagagaactctgccttcaagggacaatggccataccaccctgattctgcaacttacctaggatggagagtcgagtcccatcaccaaaatgctggggctgatgtcgacgacactctgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagacactctgtgtagcactgagcgggctggcaaggc

SEQ ID NO: 71 - DNA, 495 bp, Artificial Sequence
  source: /note="Description of Artificial Sequence: Synthetic polynucleotide"
gcctccctcgcgccatcagttcggaacgtgtagcaatcattgcagtcaaacccaggcacccccgagtcaagagtggagcccccatacctgtcacagtgagcctggtcccgttcccaaagtggaggggtgaattatgtcgacttcggaacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggattcggaacgtgtagcactgagcgggctggcaaggc

SEQ ID NO: 72 - DNA, 495 bp, Artificial Sequence
  source: /note="Description of Artificial Sequence: Synthetic polynucleotide"
gcctccctcgcgccatcagaagtaacggtgtagcagggtcgtgcaggctgggctgctcaccctctctcccacctggagcccccttcttacctagcacggtgagccgtgtccctggcccgaagaactgctcattgtgtcgacaagtaacggtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggaaagtaacggtgtagcactgagcgggctggcaaggc

SEQ ID NO: 73 - DNA, 495 bp, Artificial Sequence
  source: /note="Description of Artificial Sequence: Synthetic polynucleotide"
gcctccctcgcgccatcaggtctcctagtgtagcacctctgcccatcccgccctctcggagctctccggagccccaaccgcctccttacccagtacggtcagcctagagccttctccaaaaaacagctccccggtgtcgacgtctcctagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagtctcctagtgtagcactgagcgggctggcaaggc

SEQ ID NO: 74 - DNA, 495 bp, Artificial Sequence
  source: /note="Description of Artificial Sequence: Synthetic polynucleotide"
gcctccctcgcgccatcaggtagacacgtgtagcagcgtcccggggcgccccctccccagttccggggcttcagcgggagcccccgcttaccgagcactgtcagccgggtgcctgggccaaaatactgcgtatctgtcgacgtagacacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagtagacacgtgtagcactgagcgggctggcaaggc

SEQ ID NO: 75 - DNA, 495 bp, Artificial Sequence
  source: /note="Description of Artificial Sequence: Synthetic polynucleotide"
gcctccctcgcgccatcagcactgtacgtgtagcacgcacaaaaacccgagcgcagtctcgtccccggtcccccggcggccccagcttacccagcactgagagccgggtcccggcgccgaagtactgaatgttttgtcgaccactgtacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacactgtacgtgtagcactgagcgggctggcaaggc

SEQ ID NO: 76 - DNA, 495 bp, Artificial Sequence
  source: /note="Description of Artificial Sequence: Synthetic polynucleotide"
gcctccctcgcgccatcaggatgatccgtgtagcaccccgcaaaaaccagacccaagccgcccgcgcccgcgccccagcagcccgcgctcaccgagcaccaggagccgcgtgcctggcccgaagtactgggtctcgtcgacgatgatccgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagatgatccgtgtagcactgagcgggctggcaaggc

SEQ ID NO: 77 - DNA, 495 bp, Artificial Sequence
  source: /note="Description of Artificial Sequence: Synthetic polynucleotide"
gcctccctcgcgccatcagcgccaatagtgtagcaccgccgccttccacctgaatcccgccgcccgggtggtcccgcgaaaactcacccagcacggtcagcctgctgccggccccgaaagtcaggacgttggcccgtcgaccgccaatagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacgccaatagtgtagcactgagcgggctggcaaggc

SEQ ID NO: 78 - DNA, 495 bp, Artificial Sequence
  source: /note="Description of Artificial Sequence: Synthetic polynucleotide"
gcctccctcgcgccatcagtcaagcctgtgtagcaccaccctccgactccggggaccgaggggctggaaggtggggagacgcccgaatctcacctgtgaccgtgagcctggtgcccggcccgaagtactgctcgtgtcgactcaagcctgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggatcaagcctgtgtagcactgagcgggctggcaaggc

SEQ ID NO: 79 - DNA, 495 bp, Artificial Sequence
  source: /note="Description of Artificial Sequence: Synthetic polynucleotide"
gcctccctcgcgccatcagagagtgtctggcagttctgtggacccacttttccctgtgacggatctgcaaaagaacctgaaaaatgtcttacctacaactgtgagtctggtgccttgtccaaagaaagcttcagtgtcgacagagtgtctggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggaagagtgtctggcagttctgagcgggctggcaaggc

SEQ ID NO: 80 - DNA, 495 bp, Artificial Sequence
  source: /note="Description of Artificial Sequence: Synthetic polynucleotide"
gcctccctcgcgccatcaggttccgaatggcagttatttcccaggacagagtcctccctcatcgcacccctcctagagacccccagccttacctacaacggttaacctggtccccgaaccgaaggtgtagccatagtcgacgttccgaatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagttccgaatggcagttctgagcgggctggcaaggc

SEQ ID NO: 81 - DNA, 495 bp, Artificial Sequence
  source: /note="Description of Artificial Sequence: Synthetic polynucleotide"
gcctccctcgcgccatcagcgttactttggcagttctggattccagcccctttttgcaagttcccagctgtccagccttgacttactcacctacaacagtgagccaacttccctctccaaaatatatggtgtttcgtcgaccgttactttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacgttactttggcagttctgagcgggctggcaaggc

SEQ ID NO: 82 - DNA, 495 bp, Artificial Sequence
  source: /note="Description of Artificial Sequence: Synthetic polynucleotide"
gcctccctcgcgccatcagtaggagactggcagttctcctggaactccgaccttatgatacactatcccgaaagaagtcttttacatacccaagacagagagctgggttccactgccaaaaaacagtttttcattgtcgactaggagactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggataggagactggcagttctgagcgggctggcaaggc

SEQ ID NO: 83 - DNA, 495 bp, Artificial Sequence
  source: /note="Description of Artificial Sequence: Synthetic polynucleotide"
gcctccctcgcgccatcaggacactcttggcagttagagaactctgccttcaagggacaatggccataccaccctgattctgcaacttacctaggatggagagtcgagtcccatcaccaaaatgctggggctgatgtcgacgacactcttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagacactcttggcagttctgagcgggctggcaaggc

SEQ ID NO: 84 - DNA, 495 bp, Artificial Sequence
  source: /note="Description of Artificial Sequence: Synthetic polynucleotide"
gcctccctcgcgccatcagttcggaactggcagttatcattgcagtcaaacccaggcacccccgagtcaagagtggagcccccatacctgtcacagtgagcctggtcccgttcccaaagtggaggggtgaattatgtcgacttcggaactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggattcggaactggcagttctgagcgggctggcaaggc

SEQ ID NO: 85 - DNA, 495 bp, Artificial Sequence
  source: /note="Description of Artificial Sequence: Synthetic polynucleotide"
gcctccctcgcgccatcagaagtaacgtggcagttgggtcgtgcaggctgggctgctcaccctctctcccacctggagcccccttcttacctagcacggtgagccgtgtccctggcccgaagaactgctcattgtgtcgacaagtaacgtggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggaaagtaacgtggcagttctgagcgggctggcaaggc

SEQ ID NO: 86 - DNA, 495 bp, Artificial Sequence
  source: /note="Description of Artificial Sequence: Synthetic polynucleotide"
gcctccctcgcgccatcaggtctcctatggcagttcctctgcccatcccgccctctcggagctctccggagccccaaccgcctccttacccagtacggtcagcctagagccttctccaaaaaacagctccccggtgtcgacgtctcctatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagtctcctatggcagttctgagcgggctggcaaggc

SEQ ID NO: 87 - DNA, 495 bp, Artificial Sequence
  source: /note="Description of Artificial Sequence: Synthetic polynucleotide"
gcctccctcgcgccatcaggtagacactggcagttgcgtcccggggcgccccctccccagttccggggcttcagcgggagcccccgcttaccgagcactgtcagccgggtgcctgggccaaaatactgcgtatctgtcgacgtagacactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagtagacactggcagttctgagcgggctggcaaggc

SEQ ID NO: 88 - DNA, 495 bp, Artificial Sequence
  source: /note="Description of Artificial Sequence: Synthetic polynucleotide"
gcctccctcgcgccatcagcactgtactggcagttcgcacaaaaacccgagcgcagtctcgtccccggtcccccggcggccccagcttacccagcactgagagccgggtcccggcgccgaagtactgaatgttttgtcgaccactgtactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacactgtactggcagttctgagcgggctggcaaggc

SEQ ID NO: 89 - DNA, 495 bp, Artificial Sequence
  source: /note="Description of Artificial Sequence: Synthetic polynucleotide"
gcctccctcgcgccatcaggatgatcctggcagttccccgcaaaaaccagacccaagccgcccgcgcccgcgccccagcagcccgcgctcaccgagcaccaggagccgcgtgcctggcccgaagtactgggtctcgtcgacgatgatcctggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagatgatcctggcagttctgagcgggctggcaaggc

SEQ ID NO: 90 - DNA, 495 bp, Artificial Sequence
  source: /note="Description of Artificial Sequence: Synthetic polynucleotide"
gcctccctcgcgccatcagcgccaatatggcagttccgccgccttccacctgaatcccgccgcccgggtggtcccgcgaaaactcacccagcacggtcagcctgctgccggccccgaaagtcaggacgttggcccgtcgaccgccaatatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacgccaatatggcagttctgagcgggctggcaaggc

SEQ ID NO: 91 - DNA, 495 bp, Artificial Sequence
  source: /note="Description of Artificial Sequence: Synthetic polynucleotide"
gcctccctcgcgccatcagtcaagccttggcagttccaccctccgactccggggaccgaggggctggaaggtggggagacgcccgaatctcacctgtgaccgtgagcctggtgcccggcccgaagtactgctcgtgtcgactcaagccttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggatcaagccttggcagttctgagcgggctggcaaggc

SEQ ID NO: 92 - DNA, 495 bp, Artificial Sequence
  source: /note="Description of Artificial Sequence: Synthetic polynucleotide"
gcctccctcgcgccatcagagagtgtccagtccaactgtggacccacttttccctgtgacggatctgcaaaagaacctgaaaaatgtcttacctacaactgtgagtctggtgccttgtccaaagaaagcttcagtgtcgacagagtgtccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagagagtgtccagtccaactgagcgggctggcaaggc

SEQ ID NO: 93 - DNA, 495 bp, Artificial Sequence
  source: /note="Description of Artificial Sequence: Synthetic polynucleotide"
gcctccctcgcgccatcaggttccgaacagtccaaatttcccaggacagagtcctccctcatcgcacccctcctagagacccccagccttacctacaacggttaacctggtccccgaaccgaaggtgtagccatagtcgacgttccgaacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggttccgaacagtccaactgagcgggctggcaaggc

SEQ ID NO: 94 - DNA, 495 bp, Artificial Sequence
  source: /note="Description of Artificial Sequence: Synthetic polynucleotide"
gcctccctcgcgccatcagcgttacttcagtccaactggattccagcccctttttgcaagttcccagctgtccagccttgacttactcacctacaacagtgagccaacttccctctccaaaatatatggtgtttcgtcgaccgttacttcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcgttacttcagtccaactgagcgggctggcaaggc

SEQ ID NO: 95 - DNA, 495 bp, Artificial Sequence
  source: /note="Description of Artificial Sequence: Synthetic polynucleotide"
gcctccctcgcgccatcagtaggagaccagtccaactcctggaactccgaccttatgatacactatcccgaaagaagtcttttacatacccaagacagagagctgggttccactgccaaaaaacagtttttcattgtcgactaggagaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagtaggagaccagtccaactgagcgggctggcaaggc

SEQ ID NO: 96 - DNA, 495 bp, Artificial Sequence
  source: /note="Description of Artificial Sequence: Synthetic polynucleotide"
gcctccctcgcgccatcaggacactctcagtccaaagagaactctgccttcaagggacaatggccataccaccctgattctgcaacttacctaggatggagagtcgagtcccatcaccaaaatgctggggctgatgtcgacgacactctcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggacactctcagtccaactgagcgggctggcaaggc

SEQ ID NO: 97 - DNA, 495 bp, Artificial Sequence
  source: /note="Description of Artificial Sequence: Synthetic polynucleotide"
gcctccctcgcgccatcagttcggaaccagtccaaatcattgcagtcaaacccaggcacccccgagtcaagagtggagcccccatacctgtcacagtgagcctggtcccgttcccaaagtggaggggtgaattatgtcgacttcggaaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagttcggaaccagtccaactgagcgggctggcaaggc

SEQ ID NO: 98 - DNA, 495 bp, Artificial Sequence
  source: /note="Description of Artificial Sequence: Synthetic polynucleotide"
gcctccctcgcgccatcagaagtaacgcagtccaagggtcgtgcaggctgggctgctcaccctctctcccacctggagcccccttcttacctagcacggtgagccgtgtccctggcccgaagaactgctcattgtgtcgacaagtaacgcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagaagtaacgcagtccaactgagcgggctggcaaggc

SEQ ID NO: 99 - DNA, 495 bp, Artificial Sequence
  source: /note="Description of Artificial Sequence: Synthetic polynucleotide"
gcctccctcgcgccatcaggtctcctacagtccaacctctgcccatcccgccctctcggagctctccggagccccaaccgcctccttacccagtacggtcagcctagagccttctccaaaaaacagctccccggtgtcgacgtctcctacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggtctcctacagtccaactgagcgggctggcaaggc

SEQ ID NO: 100 - DNA, 495 bp, Artificial Sequence
  source: /note="Description of Artificial Sequence: Synthetic polynucleotide"
gcctccctcgcgccatcaggtagacaccagtccaagcgtcccggggcgccccctccccagttccggggcttcagcgggagcccccgcttaccgagcactgtcagccgggtgcctgggccaaaatactgcgtatctgtcgacgtagacaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggtagacaccagtccaactgagcgggctggcaaggc

SEQ ID NO: 101 - DNA, 495 bp, Artificial Sequence
  source: /note="Description of Artificial Sequence: Synthetic polynucleotide"
gcctccctcgcgccatcagcactgtaccagtccaacgcacaaaaacccgagcgcagtctcgtccccggtcccccggcggccccagcttacccagcactgagagccgggtcccggcgccgaagtactgaatgttttgtcgaccactgtaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcactgtaccagtccaactgagcgggctggcaaggc

SEQ ID NO: 102 - DNA, 495 bp, Artificial Sequence
  source: /note="Description of Artificial Sequence: Synthetic polynucleotide"
gcctccctcgcgccatcaggatgatcccagtccaaccccgcaaaaaccagacccaagccgcccgcgcccgcgccccagcagcccgcgctcaccgagcaccaggagccgcgtgcctggcccgaagtactgggtctcgtcgacgatgatcccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggatgatcccagtccaactgagcgggctggcaaggc

SEQ ID NO: 103 - DNA, 495 bp, Artificial Sequence
  source: /note="Description of Artificial Sequence: Synthetic polynucleotide"
gcctccctcgcgccatcagcgccaatacagtccaaccgccgccttccacctgaatcccgccgcccgggtggtcccgcgaaaactcacccagcacggtcagcctgctgccggccccgaaagtcaggacgttggcccgtcgaccgccaatacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcgccaatacagtccaactgagcgggctggcaaggc

SEQ ID NO: 104 - DNA, 495 bp, Artificial Sequence
  source: /note="Description of Artificial Sequence: Synthetic polynucleotide"
gcctccctcgcgccatcagtcaagcctcagtccaaccaccctccgactccggggaccgaggggctggaaggtggggagacgcccgaatctcacctgtgaccgtgagcctggtgcccggcccgaagtactgctcgtgtcgactcaagcctcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagtcaagcctcagtccaactgagcgggctggcaaggc

SEQ ID NO: 105 - DNA, 495 bp, Artificial Sequence
  source: /note="Description of Artificial Sequence: Synthetic polynucleotide"
gcctccctcgcgccatcagagagtgtcgtgtctacctgtggacccacttttccctgtgacggatctgcaaaagaacctgaaaaatgtcttacctacaactgtgagtctggtgccttgtccaaagaaagcttcagtgtcgacagagtgtcgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaaagagtgtcgtgtctacctgagcgggctggcaaggc

SEQ ID NO: 106 - DNA, 495 bp, Artificial Sequence
  source: /note="Description of Artificial Sequence: Synthetic polynucleotide"
gcctccctcgcgccatcaggttccgaagtgtctacatttcccaggacagagtcctccctcatcgcacccctcctagagacccccagccttacctacaacggttaacctggtccccgaaccgaaggtgtagccatagtcgacgttccgaagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagttccgaagtgtctacctgagcgggctggcaaggc

SEQ ID NO: 107 - DNA, 495 bp, Artificial Sequence
  source: /note="Description of Artificial Sequence: Synthetic polynucleotide"
gcctccctcgcgccatcagcgttacttgtgtctacctggattccagcccctttttgcaagttcccagctgtccagccttgacttactcacctacaacagtgagccaacttccctctccaaaatatatggtgtttcgtcgaccgttacttgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacgttacttgtgtctacctgagcgggctggcaaggc

SEQ ID NO: 108 - DNA, 495 bp, Artificial Sequence
  source: /note="Description of Artificial Sequence: Synthetic polynucleotide"
gcctccctcgcgccatcagtaggagacgtgtctacctcctggaactccgaccttatgatacactatcccgaaagaagtcttttacatacccaagacagagagctgggttccactgccaaaaaacagtttttcattgtcgactaggagacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaataggagacgtgtctacctgagcgggctggcaaggc

SEQ ID NO: 109 - DNA, 495 bp, Artificial Sequence
  source: /note="Description of Artificial Sequence: Synthetic polynucleotide"
gcctccctcgcgccatcaggacactctgtgtctacagagaactctgccttcaagggacaatggccataccaccctgattctgcaacttacctaggatggagagtcgagtcccatcaccaaaatgctggggctgatgtcgacgacactctgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagacactctgtgtctacctgagcgggctggcaaggc

SEQ ID NO: 110 - DNA, 495 bp, Artificial Sequence
  source: /note="Description of Artificial Sequence: Synthetic polynucleotide"
gcctccctcgcgccatcagttcggaacgtgtctacatcattgcagtcaaacccaggcacccccgagtcaagagtggagcccccatacctgtcacagtgagcctggtcccgttcccaaagtggaggggtgaattatgtcgacttcggaacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaattcggaacgtgtctacctgagcgggctggcaaggc

SEQ ID NO: 111 - DNA, 495 bp, Artificial Sequence
  source: /note="Description of Artificial Sequence: Synthetic polynucleotide"
gcctccctcgcgccatcagaagtaacggtgtctacgggtcgtgcaggctgggctgctcaccctctctcccacctggagcccccttcttacctagcacggtgagccgtgtccctggcccgaagaactgctcattgtgtcgacaagtaacggtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaaaagtaacggtgtctacctgagcgggctggcaaggc

SEQ ID NO: 112 - DNA, 495 bp, Artificial Sequence
  source: /note="Description of Artificial Sequence: Synthetic polynucleotide"
gcctccctcgcgccatcaggtctcctagtgtctaccctctgcccatcccgccctctcggagctctccggagccccaaccgcctccttacccagtacggtcagcctagagccttctccaaaaaacagctccccggtgtcgacgtctcctagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagtctcctagtgtctacctgagcgggctggcaaggc

SEQ ID NO: 113 - DNA, 495 bp, Artificial Sequence
  source: /note="Description of Artificial Sequence: Synthetic polynucleotide"
gcctccctcgcgccatcaggtagacacgtgtctacgcgtcccggggcgccccctccccagttccggggcttcagcgggagcccccgcttaccgagcactgtcagccgggtgcctgggccaaaatactgcgtatctgtcgacgtagacacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagtagacacgtgtctacctgagcgggctggcaaggc

SEQ ID NO: 114 - DNA, 495 bp, Artificial Sequence
  source: /note="Description of Artificial Sequence: Synthetic polynucleotide"
gcctccctcgcgccatcagcactgtacgtgtctaccgcacaaaaacccgagcgcagtctcgtccccggtcccccggcggccccagcttacccagcactgagagccgggtcccggcgccgaagtactgaatgttttgtcgaccactgtacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacactgtacgtgtctacctgagcgggctggcaaggc

SEQ ID NO: 115 - DNA, 495 bp, Artificial Sequence
  source: /note="Description of Artificial Sequence: Synthetic polynucleotide"
gcctccctcgcgccatcaggatgatccgtgtctacccccgcaaaaaccagacccaagccgcccgcgcccgcgccccagcagcccgcgctcaccgagcaccaggagccgcgtgcctggcccgaagtactgggtctcgtcgacgatgatccgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagatgatccgtgtctacctgagcgggctggcaaggc

SEQ ID NO: 116 - DNA, 495 bp, Artificial Sequence
  source: /note="Description of Artificial Sequence: Synthetic polynucleotide"
gcctccctcgcgccatcagcgccaatagtgtctacccgccgccttccacctgaatcccgccgcccgggtggtcccgcgaaaactcacccagcacggtcagcctgctgccggccccgaaagtcaggacgttggcccgtcgaccgccaatagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacgccaatagtgtctacctgagcgggctggcaaggc

SEQ ID NO: 117 - DNA, 495 bp, Artificial Sequence
  source: /note="Description of Artificial Sequence: Synthetic polynucleotide"
gcctccctcgcgccatcagtcaagcctgtgtctacccaccctccgactccggggaccgaggggctggaaggtggggagacgcccgaatctcacctgtgaccgtgagcctggtgcccggcccgaagtactgctcgtgtcgactcaagcctgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaatcaagcctgtgtctacctgagcgggctggcaaggc

SEQ ID NO: 118 - DNA, 495 bp, Artificial Sequence
  source: /note="Description of Artificial Sequence: Synthetic polynucleotide"
gcctccctcgcgccatcagagagtgtcgtacagtgctgtggacccacttttccctgtgacggatctgcaaaagaacctgaaaaatgtcttacctacaactgtgagtctggtgccttgtccaaagaaagcttcagtgtcgacagagtgtcgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagagagtgtcgtacagtgctgagcgggctggcaaggc

SEQ ID NO: 119 - DNA, 495 bp, Artificial Sequence
  source: /note="Description of Artificial Sequence: Synthetic polynucleotide"
gcctccctcgcgccatcaggttccgaagtacagtgatttcccaggacagagtcctccctcatcgcacccctcctagagacccccagccttacctacaacggttaacctggtccccgaaccgaaggtgtagccatagtcgacgttccgaagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggttccgaagtacagtgctgagcgggctggcaaggc

SEQ ID NO: 120 - DNA, 495 bp, Artificial Sequence
  source: /note="Description of Artificial Sequence: Synthetic polynucleotide"
gcctccctcgcgccatcagcgttacttgtacagtgctggattccagcccctttttgcaagttcccagctgtccagccttgacttactcacctacaacagtgagccaacttccctctccaaaatatatggtgtttcgtcgaccgttacttgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcgttacttgtacagtgctgagcgggctggcaaggc

SEQ ID NO: 121 - DNA, 495 bp, Artificial Sequence
  source: /note="Description of Artificial Sequence: Synthetic polynucleotide"
gcctccctcgcgccatcagtaggagacgtacagtgctcctggaactccgaccttatgatacactatcccgaaagaagtcttttacatacccaagacagagagctgggttccactgccaaaaaacagtttttcattgtcgactaggagacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagtaggagacgtacagtgctgagcgggctggcaaggc

SEQ ID NO: 122 - DNA, 495 bp, Artificial Sequence
  source: /note="Description of Artificial Sequence: Synthetic polynucleotide"
gcctccctcgcgccatcaggacactctgtacagtgagagaactctgccttcaagggacaatggccataccaccctgattctgcaacttacctaggatggagagtcgagtcccatcaccaaaatgctggggctgatgtcgacgacactctgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggacactctgtacagtgctgagcgggctggcaaggc

SEQ ID NO: 123 - DNA, 495 bp, Artificial Sequence
  source: /note="Description of Artificial Sequence: Synthetic polynucleotide"
gcctccctcgcgccatcagttcggaacgtacagtgatcattgcagtcaaacccaggcacccccgagtcaagagtggagcccccatacctgtcacagtgagcctggtcccgttcccaaagtggaggggtgaattatgtcgacttcggaacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagttcggaacgtacagtgctgagcgggctggcaaggc

SEQ ID NO: 124 - DNA, 495 bp, Artificial Sequence
  source: /note="Description of Artificial Sequence: Synthetic polynucleotide"
gcctccctcgcgccatcagaagtaacggtacagtggggtcgtgcaggctgggctgctcaccctctctcccacctggagcccccttcttacctagcacggtgagccgtgtccctggcccgaagaactgctcattgtgtcgacaagtaacggtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagaagtaacggtacagtgctgagcgggctggcaaggc

SEQ ID NO: 125 - DNA, 495 bp, Artificial Sequence
  source: /note="Description of Artificial Sequence: Synthetic polynucleotide"
gcctccctcgcgccatcaggtctcctagtacagtgcctctgcccatcccgccctctcggagctctccggagccccaaccgcctccttacccagtacggtcagcctagagccttctccaaaaaacagctccccggtgtcgacgtctcctagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggtctcctagtacagtgctgagcgggctggcaaggc

SEQ ID NO: 126 - DNA, 495 bp, Artificial Sequence
  source: /note="Description of Artificial Sequence: Synthetic polynucleotide"
gcctccctcgcgccatcaggtagacacgtacagtggcgtcccggggcgccccctccccagttccggggcttcagcgggagcccccgcttaccgagcactgtcagccgggtgcctgggccaaaatactgcgtatctgtcgacgtagacacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggtagacacgtacagtgctgagcgggctggcaaggc

SEQ ID NO: 127 - DNA, 495 bp, Artificial Sequence
  source: /note="Description of Artificial Sequence: Synthetic polynucleotide"
gcctccctcgcgccatcagcactgtacgtacagtgcgcacaaaaacccgagcgcagtctcgtccccggtcccccggcggccccagcttacccagcactgagagccgggtcccggcgccgaagtactgaatgttttgtcgaccactgtacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcactgtacgtacagtgctgagcgggctggcaaggc

SEQ ID NO: 128 - DNA, 495 bp, Artificial Sequence
  source: /note="Description of Artificial Sequence: Synthetic polynucleotide"
gcctccctcgcgccatcaggatgatccgtacagtgccccgcaaaaaccagacccaagccgcccgcgcccgcgccccagcagcccgcgctcaccgagcaccaggagccgcgtgcctggcccgaagtactgggtctcgtcgacgatgatccgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggatgatccgtacagtgctgagcgggctggcaaggc

SEQ ID NO: 129 - DNA, 495 bp, Artificial Sequence
  source: /note="Description of Artificial Sequence: Synthetic polynucleotide"
gcctccctcgcgccatcagcgccaatagtacagtgccgccgccttccacctgaatcccgccgcccgggtggtcccgcgaaaactcacccagcacggtcagcctgctgccggccccgaaagtcaggacgttggcccgtcgaccgccaatagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcgccaatagtacagtgctgagcgggctggcaaggc

SEQ ID NO: 130 - DNA, 495 bp, Artificial Sequence
  source: /note="Description of Artificial Sequence: Synthetic polynucleotide"
gcctccctcgcgccatcagtcaagcctgtacagtgccaccctccgactccggggaccgaggggctggaaggtggggagacgcccgaatctcacctgtgaccgtgagcctggtgcccggcccgaagtactgctcgtgtcgactcaagcctgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagtcaagcctgtacagtgctgagcgggctggcaaggc

SEQ ID NO: 131 - DNA, 495 bp, Artificial Sequence
  source: /note="Description of Artificial Sequence: Synthetic polynucleotide"
gcctccctcgcgccatcagagagtgtcggatcatcctgtggacccacttttccctgtgacggatctgcaaaagaacctgaaaaatgtcttacctacaactgtgagtctggtgccttgtccaaagaaagcttcagtgtcgacagagtgtcggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagagagtgtcggatcatcctgagcgggctggcaaggc

SEQ ID NO: 132 - DNA, 495 bp, Artificial Sequence
  source: /note="Description of Artificial Sequence: Synthetic polynucleotide"
gcctccctcgcgccatcaggttccgaaggatcatcatttcccaggacagagtcctccctcatcgcacccctcctagagacccccagccttacctacaacggttaacctggtccccgaaccgaaggtgtagccatagtcgacgttccgaaggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggttccgaaggatcatcctgagcgggctggcaaggc

SEQ ID NO: 133 - DNA, 495 bp, Artificial Sequence
  source: /note="Description of Artificial Sequence: Synthetic polynucleotide"
gcctccctcgcgccatcagcgttacttggatcatcctggattccagcccctttttgcaagttcccagctgtccagccttgacttactcacctacaacagtgagccaacttccctctccaaaatatatggtgtttcgtcgaccgttacttggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcgttacttggatcatcctgagcgggctggcaaggc

SEQ ID NO: 134 - DNA, 495 bp, Artificial Sequence
  source: /note="Description of Artificial Sequence: Synthetic polynucleotide"
gcctccctcgcgccatcagtaggagacggatcatcctcctggaactccgaccttatgatacactatcccgaaagaagtcttttacatacccaagacagagagctgggttccactgccaaaaaacagtttttcattgtcgactaggagacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagtaggagacggatcatcctgagcgggctggcaaggc

SEQ ID NO: 135 - DNA, 495 bp, Artificial Sequence
  source: /note="Description of Artificial Sequence: Synthetic polynucleotide"
gcctccctcgcgccatcaggacactctggatcatcagagaactctgccttcaagggacaatggccataccaccctgattctgcaacttacctaggatggagagtcgagtcccatcaccaaaatgctggggctgatgtcgacgacactctggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggacactctggatcatcctgagcgggctggcaaggc

SEQ ID NO: 136 - DNA, 495 bp, Artificial Sequence
  source: /note="Description of Artificial Sequence: Synthetic polynucleotide"
gcctccctcgcgccatcagttcggaacggatcatcatcattgcagtcaaacccaggcacccccgagtcaagagtggagcccccatacctgtcacagtgagcctggtcccgttcccaaagtggaggggtgaattatgtcgacttcggaacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagttcggaacggatcatcctgagcgggctggcaaggc

SEQ ID NO: 137 - DNA, 495 bp, Artificial Sequence
  source: /note="Description of Artificial Sequence: Synthetic polynucleotide"
gcctccctcgcgccatcagaagtaacgggatcatcgggtcgtgcaggctgggctgctcaccctctctcccacctggagcccccttcttacctagcacggtgagccgtgtccctggcccgaagaactgctcattgtgtcgacaagtaacgggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagaagtaacgggatcatcctgagcgggctggcaaggc

SEQ ID NO: 138 - DNA, 495 bp, Artificial Sequence
  source: /note="Description of Artificial Sequence: Synthetic polynucleotide"
gcctccctcgcgccatcaggtctcctaggatcatccctctgcccatcccgccctctcggagctctccggagccccaaccgcctccttacccagtacggtcagcctagagccttctccaaaaaacagctccccggtgtcgacgtctcctaggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggtctcctaggatcatcctgagcgggctggcaaggc

SEQ ID NO: 139 - DNA, 495 bp, Artificial Sequence
  source: /note="Description of Artificial Sequence: Synthetic polynucleotide"
gcctccctcgcgccatcaggtagacacggatcatcgcgtcccggggcgccccctccccagttccggggcttcagcgggagcccccgcttaccgagcactgtcagccgggtgcctgggccaaaatactgcgtatctgtcgacgtagacacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggtagacacggatcatcctgagcgggctggcaaggc

SEQ ID NO: 140 - DNA, 495 bp, Artificial Sequence
  source: /note="Description of Artificial Sequence: Synthetic polynucleotide"
gcctccctcgcgccatcagcactgtacggatcatccgcacaaaaacccgagcgcagtctcgtccccggtcccccggcggccccagcttacccagcactgagagccgggtcccggcgccgaagtactgaatgttttgtcgaccactgtacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcactgtacggatcatcctgagcgggctggcaaggc

SEQ ID NO: 141 - DNA, 495 bp, Artificial Sequence
  source: /note="Description of Artificial Sequence: Synthetic polynucleotide"
gcctccctcgcgccatcaggatgatccggatcatcccccgcaaaaaccagacccaagccgcccgcgcccgcgccccagcagcccgcgctcaccgagcaccaggagccgcgtgcctggcccgaagtactgggtctcgtcgacgatgatccggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggatgatccggatcatcctgagcgggctggcaaggc

SEQ ID NO: 142 - DNA, 495 bp, Artificial Sequence
  source: /note="Description of Artificial Sequence: Synthetic polynucleotide"
gcctccctcgcgccatcagcgccaataggatcatcccgccgccttccacctgaatcccgccgcccgggtggtcccgcgaaaactcacccagcacggtcagcctgctgccggccccgaaagtcaggacgttggcccgtcgaccgccaataggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcgccaataggatcatcctgagcgggctggcaaggc

SEQ ID NO: 143 - DNA, 495 bp, Artificial Sequence
  source: /note="Description of Artificial Sequence: Synthetic polynucleotide"
gcctccctcgcgccatcagtcaagcctggatcatcccaccctccgactccggggaccgaggggctggaaggtggggagacgcccgaatctcacctgtgaccgtgagcctggtgcccggcccgaagtactgctcgtgtcgactcaagcctggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagtcaagcctggatcatcctgagcgggctggcaaggc

SEQ ID NO: 144 - DNA, 495 bp, Artificial Sequence
  source: /note="Description of Artificial Sequence: Synthetic polynucleotide"
gcctccctcgcgccatcagagagtgtctattggcgctgtggacccacttttccctgtgacggatctgcaaaagaacctgaaaaatgtcttacctacaactgtgagtctggtgccttgtccaaagaaagcttcagtgtcgacagagtgtctattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagagagtgtctattggcgctgagcgggctggcaaggc

SEQ ID NO: 145 - DNA, 495 bp, Artificial Sequence
  source: /note="Description of Artificial Sequence: Synthetic polynucleotide"
gcctccctcgcgccatcaggttccgaatattggcgatttcccaggacagagtcctccctcatcgcacccctcctagagacccccagccttacctacaacggttaacctggtccccgaaccgaaggtgtagccatagtcgacgttccgaatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggttccgaatattggcgctgagcgggctggcaaggc

SEQ ID NO: 146 - DNA, 495 bp, Artificial Sequence
  source: /note="Description of Artificial Sequence: Synthetic polynucleotide"
gcctccctcgcgccatcagcgttactttattggcgctggattccagcccctttttgcaagttcccagctgtccagccttgacttactcacctacaacagtgagccaacttccctctccaaaatatatggtgtttcgtcgaccgttactttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcgttactttattggcgctgagcgggctggcaaggc

SEQ ID NO: 147 - DNA, 495 bp, Artificial Sequence
  source: /note="Description of Artificial Sequence: Synthetic polynucleotide"
gcctccctcgcgccatcagtaggagactattggcgctcctggaactccgaccttatgatacactatcccgaaagaagtcttttacatacccaagacagagagctgggttccactgccaaaaaacagtttttcattgtcgactaggagactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagtaggagactattggcgctgagcgggctggcaaggc

SEQ ID NO: 148 - DNA, 495 bp, Artificial Sequence
  source: /note="Description of Artificial Sequence: Synthetic polynucleotide"
gcctccctcgcgccatcaggacactcttattggcgagagaactctgccttcaagggacaatggccataccaccctgattctgcaacttacctaggatggagagtcgagtcccatcaccaaaatgctggggctgatgtcgacgacactcttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggacactcttattggcgctgagcgggctggcaaggc

SEQ ID NO: 149 - DNA, 495 bp, Artificial Sequence
  source: /note="Description of Artificial Sequence: Synthetic polynucleotide"
gcctccctcgcgccatcagttcggaactattggcgatcattgcagtcaaacccaggcacccccgagtcaagagtggagcccccatacctgtcacagtgagcctggtcccgttcccaaagtggaggggtgaattatgtcgacttcggaactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagttcggaactattggcgctgagcgggctggcaaggc

SEQ ID NO: 150 - DNA, 495 bp, Artificial Sequence
  source: /note="Description of Artificial Sequence: Synthetic polynucleotide"
gcctccctcgcgccatcagaagtaacgtattggcggggtcgtgcaggctgggctgctcaccctctctcccacctggagcccccttcttacctagcacggtgagccgtgtccctggcccgaagaactgctcattgtgtcgacaagtaacgtattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagaagtaacgtattggcgctgagcgggctggcaaggc

SEQ ID NO: 151 - DNA, 495 bp, Artificial Sequence
  source: /note="Description of Artificial Sequence: Synthetic polynucleotide"
gcctccctcgcgccatcaggtctcctatattggcgcctctgcccatcccgccctctcggagctctccggagccccaaccgcctccttacccagtacggtcagcctagagccttctccaaaaaacagctccccggtgtcgacgtctcctatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggtctcctatattggcgctgagcgggctggcaaggc

SEQ ID NO: 152 - DNA, 495 bp, Artificial Sequence
  source: /note="Description of Artificial Sequence: Synthetic polynucleotide"
gcctccctcgcgccatcaggtagacactattggcggcgtcccggggcgccccctccccagttccggggcttcagcgggagcccccgcttaccgagcactgtcagccgggtgcctgggccaaaatactgcgtatctgtcgacgtagacactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggtagacactattggcgctgagcgggctggcaaggc

SEQ ID NO: 153 - DNA, 495 bp, Artificial Sequence
  source: /note="Description of Artificial Sequence: Synthetic polynucleotide"
gcctccctcgcgccatcagcactgtactattggcgcgcacaaaaacccgagcgcagtctcgtccccggtcccccggcggccccagcttacccagcactgagagccgggtcccggcgccgaagtactgaatgttttgtcgaccactgtactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcactgtactattggcgctgagcgggctggcaaggc

SEQ ID NO: 154 - DNA, 495 bp, Artificial Sequence
  source: /note="Description of Artificial Sequence: Synthetic polynucleotide"
gcctccctcgcgccatcaggatgatcctattggcgccccgcaaaaaccagacccaagccgcccgcgcccgcgccccagcagcccgcgctcaccgagcaccaggagccgcgtgcctggcccgaagtactgggtctcgtcgacgatgatcctattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggatgatcctattggcgctgagcgggctggcaaggc

SEQ ID NO: 155 - DNA, 495 bp, Artificial Sequence
  source: /note="Description of Artificial Sequence: Synthetic polynucleotide"
gcctccctcgcgccatcagcgccaatatattggcgccgccgccttccacctgaatcccgccgcccgggtggtcccgcgaaaactcacccagcacggtcagcctgctgccggccccgaaagtcaggacgttggcccgtcgaccgccaatatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcgccaatatattggcgctgagcgggctggcaaggc

SEQ ID NO: 156 - DNA, 495 bp, Artificial Sequence
  source: /note="Description of Artificial Sequence: Synthetic polynucleotide"
gcctccctcgcgccatcagtcaagccttattggcgccaccctccgactccggggaccgaggggctggaaggtggggagacgcccgaatctcacctgtgaccgtgagcctggtgcccggcccgaagtactgctcgtgtcgactcaagccttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagtcaagccttattggcgctgagcgggctggcaaggc

SEQ ID NO: 157 - DNA, 495 bp, Artificial Sequence
  source: /note="Description of Artificial Sequence: Synthetic polynucleotide"
gcctccctcgcgccatcagagagtgtcaggcttgactgtggacccacttttccctgtgacggatctgcaaaagaacctgaaaaatgtcttacctacaactgtgagtctggtgccttgtccaaagaaagcttcagtgtcgacagagtgtcaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagagagtgtcaggcttgactgagcgggctggcaaggc

SEQ ID NO: 158 - DNA, 495 bp, Artificial Sequence
  source: /note="Description of Artificial Sequence: Synthetic polynucleotide"
gcctccctcgcgccatcaggttccgaaaggcttgaatttcccaggacagagtcctccctcatcgcacccctcctagagacccccagccttacctacaacggttaacctggtccccgaaccgaaggtgtagccatagtcgacgttccgaaaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggttccgaaaggcttgactgagcgggctggcaaggc

SEQ ID NO: 159 - DNA, 495 bp, Artificial Sequence
  source: /note="Description of Artificial Sequence: Synthetic polynucleotide"
gcctccctcgcgccatcagcgttacttaggcttgactggattccagcccctttttgcaagttcccagctgtccagccttgacttactcacctacaacagtgagccaacttccctctccaaaatatatggtgtttcgtcgaccgttacttaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcgttacttaggcttgactgagcgggctggcaaggc

SEQ ID NO: 160 - DNA, 495 bp, Artificial Sequence
  source: /note="Description of Artificial Sequence: Synthetic polynucleotide"
gcctccctcgcgccatcagtaggagacaggcttgactcctggaactccgaccttatgatacactatcccgaaagaagtcttttacatacccaagacagagagctgggttccactgccaaaaaacagtttttcattgtcgactaggagacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagtaggagacaggcttgactgagcgggctggcaaggc

SEQ ID NO: 161 - DNA, 495 bp, Artificial Sequence
  source: /note="Description of Artificial Sequence: Synthetic polynucleotide"
gcctccctcgcgccatcaggacactctaggcttgaagagaactctgccttcaagggacaatggccataccaccctgattctgcaacttacctaggatggagagtcgagtcccatcaccaaaatgctggggctgatgtcgacgacactctaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggacactctaggcttgactgagcgggctggcaaggc

SEQ ID NO: 162 - DNA, 495 bp, Artificial Sequence
  source: /note="Description of Artificial Sequence: Synthetic polynucleotide"
gcctccctcgcgccatcagttcggaacaggcttgaatcattgcagtcaaacccaggcacccccgagtcaagagtggagcccccatacctgtcacagtgagcctggtcccgttcccaaagtggaggggtgaattatgtcgacttcggaacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagttcggaacaggcttgactgagcgggctggcaaggc

SEQ ID NO: 163 - DNA, 495 bp, Artificial Sequence
  source: /note="Description of Artificial Sequence: Synthetic polynucleotide"
gcctccctcgcgccatcagaagtaacgaggcttgagggtcgtgcaggctgggctgctcaccctctctcccacctggagcccccttcttacctagcacggtgagccgtgtccctggcccgaagaactgctcattgtgtcgacaagtaacgaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagaagtaacgaggcttgactgagcgggctggcaaggc

SEQ ID NO: 164 - DNA, 495 bp, Artificial Sequence
  source: /note="Description of Artificial Sequence: Synthetic polynucleotide"
gcctccctcgcgccatcaggtctcctaaggcttgacctctgcccatcccgccctctcggagctctccggagccccaaccgcctccttacccagtacggtcagcctagagccttctccaaaaaacagctccccggtgtcgacgtctcctaaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggtctcctaaggcttgactgagcgggctggcaaggc

SEQ ID NO: 165 - DNA, 495 bp, Artificial Sequence
  source: /note="Description of Artificial Sequence: Synthetic polynucleotide"
gcctccctcgcgccatcaggtagacacaggcttgagcgtcccggggcgccccctccccagttccggggcttcagcgggagcccccgcttaccgagcactgtcagccgggtgcctgggccaaaatactgcgtatctgtcgacgtagacacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggtagacacaggcttgactgagcgggctggcaaggc

SEQ ID NO: 166 - DNA, 495 bp, Artificial Sequence
  source: /note="Description of Artificial Sequence: Synthetic polynucleotide"
gcctccctcgcgccatcagcactgtacaggcttgacgcacaaaaacccgagcgcagtctcgtccccggtcccccggcggccccagcttacccagcactgagagccgggtcccggcgccgaagtactgaatgttttgtcgaccactgtacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcactgtacaggcttgactgagcgggctggcaaggc

SEQ ID NO: 167 - DNA, 495 bp, Artificial Sequence
  source: /note="Description of Artificial Sequence: Synthetic polynucleotide"
gcctccctcgcgccatcaggatgatccaggcttgaccccgcaaaaaccagacccaagccgcccgcgcccgcgccccagcagcccgcgctcaccgagcaccaggagccgcgtgcctggcccgaagtactgggtctcgtcgacgatgatccaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggatgatccaggcttgactgagcgggctggcaaggc

SEQ ID NO: 168 - DNA, 495 bp, Artificial Sequence
  source: /note="Description of Artificial Sequence: Synthetic polynucleotide"
gcctccctcgcgccatcagcgccaataaggcttgaccgccgccttccacctgaatcccgccgcccgggtggtcccgcgaaaactcacccagcacggtcagcctgctgccggccccgaaagtcaggacgttggcccgtcgaccgccaataaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcgccaataaggcttgactgagcgggctggcaaggc

SEQ ID NO: 169 - DNA, 495 bp, Artificial Sequence
  source: /note="Description of Artificial Sequence: Synthetic polynucleotide"
gcctccctcgcgccatcagtcaagcctaggcttgaccaccctccgactccggggaccgaggggctggaaggtggggagacgcccgaatctcacctgtgaccgtgagcctggtgcccggcccgaagtactgctcgtgtcgactcaagcctaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagtcaagcctaggcttgactgagcgggctggcaaggc

SEQ ID NO: 170 - DNA, 495 bp, Artificial Sequence
  source: /note="Description of Artificial Sequence: Synthetic polynucleotide"
gcctccctcgcgccatcagagagtgtcacacacgtctgtggacccacttttccctgtgacggatctgcaaaagaacctgaaaaatgtcttacctacaactgtgagtctggtgccttgtccaaagaaagcttcagtgtcgacagagtgtcacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagagagtgtcacacacgtctgagcgggctggcaaggc

SEQ ID NO: 171 - DNA, 495 bp, Artificial Sequence
  source: /note="Description of Artificial Sequence: Synthetic polynucleotide"
gcctccctcgcgccatcaggttccgaaacacacgtatttcccaggacagagtcctccctcatcgcacccctcctagagacccccagccttacctacaacggttaacctggtccccgaaccgaaggtgtagccatagtcgacgttccgaaacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggttccgaaacacacgtctgagcgggctggcaaggc

SEQ ID NO: 172 - DNA, 495 bp, Artificial Sequence
  source: /note="Description of Artificial Sequence: Synthetic polynucleotide"
gcctccctcgcgccatcagcgttacttacacacgtctggattccagcccctttttgcaagttcccagctgtccagccttgacttactcacctacaacagtgagccaacttccctctccaaaatatatggtgtttcgtcgaccgttacttacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcgttacttacacacgtctgagcgggctggcaaggc

SEQ ID NO: 173 - DNA, 495 bp, Artificial Sequence
  source: /note="Description of Artificial Sequence: Synthetic polynucleotide"
gcctccctcgcgccatcagtaggagacacacacgtctcctggaactccgaccttatgatacactatcccgaaagaagtcttttacatacccaagacagagagctgggttccactgccaaaaaacagtttttcattgtcgactaggagacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagtaggagacacacacgtctgagcgggctggcaaggc

SEQ ID NO: 174 - DNA, 495 bp, Artificial Sequence
  source: /note="Description of Artificial Sequence: Synthetic polynucleotide"
gcctccctcgcgccatcaggacactctacacacgtagagaactctgccttcaagggacaatggccataccaccctgattctgcaacttacctaggatggagagtcgagtcccatcaccaaaatgctggggctgatgtcgacgacactctacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggacactctacacacgtctgagcgggctggcaaggc

SEQ ID NO: 175 - DNA, 495 bp, Artificial Sequence
  source: /note="Description of Artificial Sequence: Synthetic polynucleotide"
gcctccctcgcgccatcagttcggaacacacacgtatcattgcagtcaaacccaggcacccccgagtcaagagtggagcccccatacctgtcacagtgagcctggtcccgttcccaaagtggaggggtgaattatgtcgacttcggaacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagttcggaacacacacgtctgagcgggctggcaaggc

SEQ ID NO: 176 - DNA, 495 bp, Artificial Sequence
  source: /note="Description of Artificial Sequence: Synthetic polynucleotide"
gcctccctcgcgccatcagaagtaacgacacacgtgggtcgtgcaggctgggctgctcaccctctctcccacctggagcccccttcttacctagcacggtgagccgtgtccctggcccgaagaactgctcattgtgtcgacaagtaacgacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagaagtaacgacacacgtctgagcgggctggcaaggc

SEQ ID NO: 177 - DNA, 495 bp, Artificial Sequence
  source: /note="Description of Artificial Sequence: Synthetic polynucleotide"
gcctccctcgcgccatcaggtctcctaacacacgtcctctgcccatcccgccctctcggagctctccggagccccaaccgcctccttacccagtacggtcagcctagagccttctccaaaaaacagctccccggtgtcgacgtctcctaacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggtctcctaacacacgtctgagcgggctggcaaggc

SEQ ID NO: 178 - DNA, 495 bp, Artificial Sequence
  source: /note="Description of Artificial Sequence: Synthetic polynucleotide"
gcctccctcgcgccatcaggtagacacacacacgtgcgtcccggggcgccccctccccagttccggggcttcagcgggagcccccgcttaccgagcactgtcagccgggtgcctgggccaaaatactgcgtatctgtcgacgtagacacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggtagacacacacacgtctgagcgggctggcaaggc

SEQ ID NO: 179 - DNA, 495 bp, Artificial Sequence
  source: /note="Description of Artificial Sequence: Synthetic polynucleotide"
gcctccctcgcgccatcagcactgtacacacacgtcgcacaaaaacccgagcgcagtctcgtccccggtcccccggcggccccagcttacccagcactgagagccgggtcccggcgccgaagtactgaatgttttgtcgaccactgtacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcactgtacacacacgtctgagcgggctggcaaggc

SEQ ID NO: 180 - DNA, 495 bp, Artificial Sequence
  source: /note="Description of Artificial Sequence: Synthetic polynucleotide"
gcctccctcgcgccatcaggatgatccacacacgtccccgcaaaaaccagacccaagccgcccgcgcccgcgccccagcagcccgcgctcaccgagcaccaggagccgcgtgcctggcccgaagtactgggtctcgtcgacgatgatccacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggatgatccacacacgtctgagcgggctggcaaggc

SEQ ID NO: 181 - DNA, 495 bp, Artificial Sequence
  source: /note="Description of Artificial Sequence: Synthetic polynucleotide"
gcctccctcgcgccatcagcgccaataacacacgtccgccgccttccacctgaatcccgccgcccgggtggtcccgcgaaaactcacccagcacggtcagcctgctgccggccccgaaagtcaggacgttggcccgtcgaccgccaataacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcgccaataacacacgtctgagcgggctggcaaggc

SEQ ID NO: 182 - DNA, 495 bp, Artificial Sequence
  source: /note="Description of Artificial Sequence: Synthetic polynucleotide"
gcctccctcgcgccatcagtcaagcctacacacgtccaccctccgactccggggaccgaggggctggaaggtggggagacgcccgaatctcacctgtgaccgtgagcctggtgcccggcccgaagtactgctcgtgtcgactcaagcctacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagtcaagcctacacacgtctgagcgggctggcaaggc

SEQ ID NO: 183 - DNA, 495 bp, Artificial Sequence
  source: /note="Description of Artificial Sequence: Synthetic polynucleotide"
gcctccctcgcgccatcagagagtgtctagacggactgtggacccacttttccctgtgacggatctgcaaaagaacctgaaaaatgtcttacctacaactgtgagtctggtgccttgtccaaagaaagcttcagtgtcgacagagtgtctagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagagagtgtctagacggactgagcgggctggcaaggc

SEQ ID NO: 184 - DNA, 495 bp, Artificial Sequence
  source: /note="Description of Artificial Sequence: Synthetic polynucleotide"
gcctccctcgcgccatcaggttccgaatagacggaatttcccaggacagagtcctccctcatcgcacccctcctagagacccccagccttacctacaacggttaacctggtccccgaaccgaaggtgtagccatagtcgacgttccgaatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggttccgaatagacggactgagcgggctggcaaggc

SEQ ID NO: 185 - DNA, 495 bp, Artificial Sequence
  source: /note="Description of Artificial Sequence: Synthetic polynucleotide"
gcctccctcgcgccatcagcgttactttagacggactggattccagcccctttttgcaagttcccagctgtccagccttgacttactcacctacaacagtgagccaacttccctctccaaaatatatggtgtttcgtcgaccgttactttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcgttactttagacggactgagcgggctggcaaggc

SEQ ID NO: 186 - DNA, 495 bp, Artificial Sequence
  source: /note="Description of Artificial Sequence: Synthetic polynucleotide"
gcctccctcgcgccatcagtaggagactagacggactcctggaactccgaccttatgatacactatcccgaaagaagtcttttacatacccaagacagagagctgggttccactgccaaaaaacagtttttcattgtcgactaggagactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagtaggagactagacggactgagcgggctggcaaggc

SEQ ID NO: 187 - DNA, 495 bp, Artificial Sequence
  source: /note="Description of Artificial Sequence: Synthetic polynucleotide"
gcctccctcgcgccatcaggacactcttagacggaagagaactctgccttcaagggacaatggccataccaccctgattctgcaacttacctaggatggagagtcgagtcccatcaccaaaatgctggggctgatgtcgacgacactcttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggacactcttagacggactgagcgggctggcaaggc

SEQ ID NO: 188 - DNA, 495 bp, Artificial Sequence
  source: /note="Description of Artificial Sequence: Synthetic polynucleotide"
gcctccctcgcgccatcagttcggaactagacggaatcattgcagtcaaacccaggcacccccgagtcaagagtggagcccccatacctgtcacagtgagcctggtcccgttcccaaagtggaggggtgaattatgtcgacttcggaactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagttcggaactagacggactgagcgggctggcaaggc

SEQ ID NO: 189 - DNA, 495 bp, Artificial Sequence
  source: /note="Description of Artificial Sequence: Synthetic polynucleotide"
gcctccctcgcgccatcagaagtaacgtagacggagggtcgtgcaggctgggctgctcaccctctctcccacctggagcccccttcttacctagcacggtgagccgtgtccctggcccgaagaactgctcattgtgtcgacaagtaacgtagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagaagtaacgtagacggactgagcgggctggcaaggc

SEQ ID NO: 190 - DNA, 495 bp, Artificial Sequence
  source: /note="Description of Artificial Sequence: Synthetic polynucleotide"
gcctccctcgcgccatcaggtctcctatagacggacctctgcccatcccgccctctcggagctctccggagccccaaccgcctccttacccagtacggtcagcctagagccttctccaaaaaacagctccccggtgtcgacgtctcctatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggtctcctatagacggactgagcgggctggcaaggc

SEQ ID NO: 191 - DNA, 495 bp, Artificial Sequence
  source: /note="Description of Artificial Sequence: Synthetic polynucleotide"
gcctccctcgcgccatcaggtagacactagacggagcgtcccggggcgccccctccccagttccggggcttcagcgggagcccccgcttaccgagcactgtcagccgggtgcctgggccaaaatactgcgtatctgtcgacgtagacactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggtagacactagacggactgagcgggctggcaaggc

SEQ ID NO: 192 - DNA, 495 bp, Artificial Sequence
  source: /note="Description of Artificial Sequence: Synthetic polynucleotide"
gcctccctcgcgccatcagcactgtactagacggacgcacaaaaacccgagcgcagtctcgtccccggtcccccggcggccccagcttacccagcactgagagccgggtcccggcgccgaagtactgaatgttttgtcgaccactgtactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcactgtactagacggactgagcgggctggcaaggc

SEQ ID NO: 193 - DNA, 495 bp, Artificial Sequence
  source: /note="Description of Artificial Sequence: Synthetic polynucleotide"
gcctccctcgcgccatcaggatgatcctagacggaccccgcaaaaaccagacccaagccgcccgcgcccgcgccccagcagcccgcgctcaccgagcaccaggagccgcgtgcctggcccgaagtactgggtctcgtcgacgatgatcctagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggatgatcctagacggactgagcgggctggcaaggc

SEQ ID NO: 194 - DNA, 495 bp, Artificial Sequence
  source: /note="Description of Artificial Sequence: Synthetic polynucleotide"
gcctccctcgcgccatcagcgccaatatagacggaccgccgccttccacctgaatcccgccgcccgggtggtcccgcgaaaactcacccagcacggtcagcctgctgccggccccgaaagtcaggacgttggcccgtcgaccgccaatatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcgccaatatagacggactgagcgggctggcaaggc

SEQ ID NO: 195 - DNA, 495 bp, Artificial Sequence
  source: /note="Description of Artificial Sequence: Synthetic polynucleotide"
gcctccctcgcgccatcagtcaagccttagacggaccaccctccgactccggggaccgaggggctggaaggtggggagacgcccgaatctcacctgtgaccgtgagcctggtgcccggcccgaagtactgctcgtgtcgactcaagccttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagtcaagccttagacggactgagcgggctggcaaggc

SEQ ID NO: 196 - DNA, 495 bp, Artificial Sequence
  source: /note="Description of Artificial Sequence: Synthetic polynucleotide"
gcctccctcgcgccatcagagagtgtccagctcttctgtggacccacttttccctgtgacggatctgcaaaagaacctgaaaaatgtcttacctacaactgtgagtctggtgccttgtccaaagaaagcttcagtgtcgacagagtgtccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagagagtgtccagctcttctgagcgggctggcaaggc

SEQ ID NO: 197 - DNA, 495 bp, Artificial Sequence
  source: /note="Description of Artificial Sequence: Synthetic polynucleotide"
gcctccctcgcgccatcaggttccgaacagctcttatttcccaggacagagtcctccctcatcgcacccctcctagagacccccagccttacctacaacggttaacctggtccccgaaccgaaggtgtagccatagtcgacgttccgaacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggttccgaacagctcttctgagcgggctggcaaggc

SEQ ID NO: 198 - DNA, 495 bp, Artificial Sequence
  source: /note="Description of Artificial Sequence: Synthetic polynucleotide"
gcctccctcgcgccatcagcgttacttcagctcttctggattccagcccctttttgcaagttcccagctgtccagccttgacttactcacctacaacagtgagccaacttccctctccaaaatatatggtgtttcgtcgaccgttacttcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcgttacttcagctcttctgagcgggctggcaaggc

SEQ ID NO: 199 - DNA, 495 bp, Artificial Sequence
  source: /note="Description of Artificial Sequence: Synthetic polynucleotide"
gcctccctcgcgccatcagtaggagaccagctcttctcctggaactccgaccttatgatacactatcccgaaagaagtcttttacatacccaagacagagagctgggttccactgccaaaaaacagtttttcattgtcgactaggagaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagtaggagaccagctcttctgagcgggctggcaaggc

SEQ ID NO: 200 - DNA, 495 bp, Artificial Sequence
  source: /note="Description of Artificial Sequence: Synthetic polynucleotide"
gcctccctcgcgccatcaggacactctcagctcttagagaactctgccttcaagggacaatggccataccaccctgattctgcaacttacctaggatggagagtcgagtcccatcaccaaaatgctggggctgatgtcgacgacactctcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggacactctcagctcttctgagcgggctggcaaggc

SEQ ID NO: 201 - DNA, 495 bp, Artificial Sequence
  source: /note="Description of Artificial Sequence: Synthetic polynucleotide"
gcctccctcgcgccatcagttcggaaccagctcttatcattgcagtcaaacccaggcacccccgagtcaagagtggagcccccatacctgtcacagtgagcctggtcccgttcccaaagtggaggggtgaattatgtcgacttcggaaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagttcggaaccagctcttctgagcgggctggcaaggc

SEQ ID NO: 202 - DNA, 495 bp, Artificial Sequence
  source: /note="Description of Artificial Sequence: Synthetic polynucleotide"
gcctccctcgcgccatcagaagtaacgcagctcttgggtcgtgcaggctgggctgctcaccctctctcccacctggagcccccttcttacctagcacggtgagccgtgtccctggcccgaagaactgctcattgtgtcgacaagtaacgcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagaagtaacgcagctcttctgagcgggctggcaaggc

SEQ ID NO: 203 - DNA, 495 bp, Artificial Sequence
  source: /note="Description of Artificial Sequence: Synthetic polynucleotide"
gcctccctcgcgccatcaggtctcctacagctcttcctctgcccatcccgccctctcggagctctccggagccccaaccgcctccttacccagtacggtcagcctagagccttctccaaaaaacagctccccggtgtcgacgtctcctacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggtctcctacagctcttctgagcgggctggcaaggc

SEQ ID NO: 204 - DNA, 495 bp, Artificial Sequence
  source: /note="Description of Artificial Sequence: Synthetic polynucleotide"
gcctccctcgcgccatcaggtagacaccagctcttgcgtcccggggcgccccctccccagttccggggcttcagcgggagcccccgcttaccgagcactgtcagccgggtgcctgggccaaaatactgcgtatctgtcgacgtagacaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggtagacaccagctcttctgagcgggctggcaaggc

SEQ ID NO: 205 - DNA, 495 bp, Artificial Sequence
  source: /note="Description of Artificial Sequence: Synthetic polynucleotide"
gcctccctcgcgccatcagcactgtaccagctcttcgcacaaaaacccgagcgcagtctcgtccccggtcccccggcggccccagcttacccagcactgagagccgggtcccggcgccgaagtactgaatgttttgtcgaccactgtaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcactgtaccagctcttctgagcgggctggcaaggc

SEQ ID NO: 206 - DNA, 495 bp, Artificial Sequence
  source: /note="Description of Artificial Sequence: Synthetic polynucleotide"
gcctccctcgcgccatcaggatgatcccagctcttccccgcaaaaaccagacccaagccgcccgcgcccgcgccccagcagcccgcgctcaccgagcaccaggagccgcgtgcctggcccgaagtactgggtctcgtcgacgatgatcccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggatgatcccagctcttctgagcgggctggcaaggc

SEQ ID NO: 207 - DNA, 495 bp, Artificial Sequence
  source: /note="Description of Artificial Sequence: Synthetic polynucleotide"
gcctccctcgcgccatcagcgccaatacagctcttccgccgccttccacctgaatcccgccgcccgggtggtcccgcgaaaactcacccagcacggtcagcctgctgccggccccgaaagtcaggacgttggcccgtcgaccgccaatacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcgccaatacagctcttctgagcgggctggcaaggc

SEQ ID NO: 208 - DNA, 495 bp, Artificial Sequence
  source: /note="Description of Artificial Sequence: Synthetic polynucleotide"
gcctccctcgcgccatcagtcaagcctcagctcttccaccctccgactccggggaccgaggggctggaaggtggggagacgcccgaatctcacctgtgaccgtgagcctggtgcccggcccgaagtactgctcgtgtcgactcaagcctcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagtcaagcctcagctcttctgagcgggctggcaaggc

SEQ ID NO: 209 - DNA, 495 bp, Artificial Sequence
  source: /note="Description of Artificial Sequence: Synthetic polynucleotide"
gcctccctcgcgccatcagagagtgtcgagcgatactgtggacccacttttccctgtgacggatctgcaaaagaacctgaaaaatgtcttacctacaactgtgagtctggtgccttgtccaaagaaagcttcagtgtcgacagagtgtcgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagagagtgtcgagcgatactgagcgggctggcaaggc

SEQ ID NO: 210 - DNA, 495 bp, Artificial Sequence
  source: /note="Description of Artificial Sequence: Synthetic polynucleotide"
gcctccctcgcgccatcaggttccgaagagcgataatttcccaggacagagtcctccctcatcgcacccctcctagagacccccagccttacctacaacggttaacctggtccccgaaccgaaggtgtagccatagtcgacgttccgaagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggttccgaagagcgatactgagcgggctggcaaggc

SEQ ID NO: 211 - DNA, 495 bp, Artificial Sequence
  source: /note="Description of Artificial Sequence: Synthetic polynucleotide"
gcctccctcgcgccatcagcgttacttgagcgatactggattccagcccctttttgcaagttcccagctgtccagccttgacttactcacctacaacagtgagccaacttccctctccaaaatatatggtgtttcgtcgaccgttacttgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgttacttgagcgatactgagcgggctggcaaggc

SEQ ID NO: 212 - DNA, 495 bp, Artificial Sequence
  source: /note="Description of Artificial Sequence: Synthetic polynucleotide"
gcctccctcgcgccatcagtaggagacgagcgatactcctggaactccgaccttatgatacactatcccgaaagaagtcttttacatacccaagacagagagctgggttccactgccaaaaaacagtttttcattgtcgactaggagacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtaggagacgagcgatactgagcgggctggcaaggc

SEQ ID NO: 213 - DNA, 495 bp, Artificial Sequence
  source: /note="Description of Artificial Sequence: Synthetic polynucleotide"
gcctccctcgcgccatcaggacactctgagcgataagagaactctgccttcaagggacaatggccataccaccctgattctgcaacttacctaggatggagagtcgagtcccatcaccaaaatgctggggctgatgtcgacgacactctgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggacactctgagcgatactgagcgggctggcaaggc

SEQ ID NO: 214 - DNA, 495 bp, Artificial Sequence
  source: /note="Description of Artificial Sequence: Synthetic polynucleotide"
gcctccctcgcgccatcagttcggaacgagcgataatcattgcagtcaaacccaggcacccccgagtcaagagtggagcccccatacctgtcacagtgagcctggtcccgttcccaaagtggaggggtgaattatgtcgacttcggaacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagttcggaacgagcgatactgagcgggctggcaaggc

SEQ ID NO: 215 - DNA, 495 bp, Artificial Sequence
  source: /note="Description of Artificial Sequence: Synthetic polynucleotide"
gcctccctcgcgccatcagaagtaacggagcgatagggtcgtgcaggctgggctgctcaccctctctcccacctggagcccccttcttacctagcacggtgagccgtgtccctggcccgaagaactgctcattgtgtcgacaagtaacggagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagaagtaacggagcgatactgagcgggctggcaaggc

SEQ ID NO: 216 - DNA, 495 bp, Artificial Sequence
  source: /note="Description of Artificial Sequence: Synthetic polynucleotide"
gcctccctcgcgccatcaggtctcctagagcgatacctctgcccatcccgccctctcggagctctccggagccccaaccgcctccttacccagtacggtcagcctagagccttctccaaaaaacagctccccggtgtcgacgtctcctagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtctcctagagcgatactgagcgggctggcaaggc

SEQ ID NO: 217 - DNA, 495 bp, Artificial Sequence
  source: /note="Description of Artificial Sequence: Synthetic polynucleotide"
gcctccctcgcgccatcaggtagacacgagcgatagcgtcccggggcgccccctccccagttccggggcttcagcgggagcccccgcttaccgagcactgtcagccgggtgcctgggccaaaatactgcgtatctgtcgacgtagacacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtagacacgagcgatactgagcgggctggcaaggc

SEQ ID NO: 218 - DNA, 495 bp, Artificial Sequence
  source: /note="Description of Artificial Sequence: Synthetic polynucleotide"
gcctccctcgcgccatcagcactgtacgagcgatacgcacaaaaacccgagcgcagtctcgtccccggtcccccggcggccccagcttacccagcactgagagccgggtcccggcgccgaagtactgaatgttttgtcgaccactgtacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcactgtacgagcgatactgagcgggctggcaaggc

SEQ ID NO: 219 - DNA, 495 bp, Artificial Sequence
  source: /note="Description of Artificial Sequence: Synthetic polynucleotide"
gcctccctcgcgccatcaggatgatccgagcgataccccgcaaaaaccagacccaagccgcccgcgcccgcgccccagcagcccgcgctcaccgagcaccaggagccgcgtgcctggcccgaagtactgggtctcgtcgacgatgatccgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggatgatccgagcgatactgagcgggctggcaaggc

SEQ ID NO: 220 - DNA, 495 bp, Artificial Sequence
  source: /note="Description of Artificial Sequence: Synthetic polynucleotide"
gcctccctcgcgccatcagcgccaatagagcgataccgccgccttccacctgaatcccgccgcccgggtggtcccgcgaaaactcacccagcacggtcagcctgctgccggccccgaaagtcaggacgttggcccgtcgaccgccaatagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgccaatagagcgatactgagcgggctggcaaggc

SEQ ID NO: 221 - DNA, 495 bp, Artificial Sequence
  source: /note="Description of Artificial Sequence: Synthetic polynucleotide"
gcctccctcgcgccatcagtcaagcctgagcgataccaccctccgactccggggaccgaggggctggaaggtggggagacgcccgaatctcacctgtgaccgtgagcctggtgcccggcccgaagtactgctcgtgtcgactcaagcctgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtcaagcctgagcgatactgagcgggctggcaaggc

SEQ ID NO: 222 - DNA, 495 bp, Artificial Sequence
  source: /note="Description of Artificial Sequence: Synthetic polynucleotide"
gcctccctcgcgccatcagagagtgtcgcatctgactgtggacccacttttccctgtgacggatctgcaaaagaacctgaaaaatgtcttacctacaactgtgagtctggtgccttgtccaaagaaagcttcagtgtcgacagagtgtcgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagagagtgtcgcatctgactgagcgggctggcaaggc

SEQ ID NO: 223 - DNA, 495 bp, Artificial Sequence
  source: /note="Description of Artificial Sequence: Synthetic polynucleotide"
gcctccctcgcgccatcaggttccgaagcatctgaatttcccaggacagagtcctccctcatcgcacccctcctagagacccccagccttacctacaacggttaacctggtccccgaaccgaaggtgtagccatagtcgacgttccgaagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggttccgaagcatctgactgagcgggctggcaaggc

SEQ ID NO: 224 - DNA, 495 bp, Artificial Sequence
  source: /note="Description of Artificial Sequence: Synthetic polynucleotide"
gcctccctcgcgccatcagcgttacttgcatctgactggattccagcccctttttgcaagttcccagctgtccagccttgacttactcacctacaacagtgagccaacttccctctccaaaatatatggtgtttcgtcgaccgttacttgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgttacttgcatctgactgagcgggctggcaaggc

SEQ ID NO: 225 - DNA, 495 bp, Artificial Sequence
  source: /note="Description of Artificial Sequence: Synthetic polynucleotide"
gcctccctcgcgccatcagtaggagacgcatctgactcctggaactccgaccttatgatacactatcccgaaagaagtcttttacatacccaagacagagagctgggttccactgccaaaaaacagtttttcattgtcgactaggagacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtaggagacgcatctgactgagcgggctggcaaggc

SEQ ID NO: 226 - DNA, 495 bp, Artificial Sequence
  source: /note="Description of Artificial Sequence: Synthetic polynucleotide"
gcctccctcgcgccatcaggacactctgcatctgaagagaactctgccttcaagggacaatggccataccaccctgattctgcaacttacctaggatggagagtcgagtcccatcaccaaaatgctggggctgatgtcgacgacactctgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggacactctgcatctgactgagcgggctggcaaggc

SEQ ID NO: 227 - DNA, 495 bp, Artificial Sequence
  source: /note="Description of Artificial Sequence: Synthetic polynucleotide"
gcctccctcgcgccatcagttcggaacgcatctgaatcattgcagtcaaacccaggcacccccgagtcaagagtggagcccccatacctgtcacagtgagcctggtcccgttcccaaagtggaggggtgaattatgtcgacttcggaacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagttcggaacgcatctgactgagcgggctggcaaggc

SEQ ID NO: 228 - DNA, 495 bp, Artificial Sequence
  source: /note="Description of Artificial Sequence: Synthetic polynucleotide"
gcctccctcgcgccatcagaagtaacggcatctgagggtcgtgcaggctgggctgctcaccctctctcccacctggagcccccttcttacctagcacggtgagccgtgtccctggcccgaagaactgctcattgtgtcgacaagtaacggcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagaagtaacggcatctgactgagcgggctggcaaggc

SEQ ID NO: 229 - DNA, 495 bp, Artificial Sequence
  source: /note="Description of Artificial Sequence: Synthetic polynucleotide"
gcctccctcgcgccatcaggtctcctagcatctgacctctgcccatcccgccctctcggagctctccggagccccaaccgcctccttacccagtacggtcagcctagagccttctccaaaaaacagctccccggtgtcgacgtctcctagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtctcctagcatctgactgagcgggctggcaaggc

SEQ ID NO: 230 - DNA, 495 bp, Artificial Sequence
  source: /note="Description of Artificial Sequence: Synthetic polynucleotide"
gcctccctcgcgccatcaggtagacacgcatctgagcgtcccggggcgccccctccccagttccggggcttcagcgggagcccccgcttaccgagcactgtcagccgggtgcctgggccaaaatactgcgtatctgtcgacgtagacacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtagacacgcatctgactgagcgggctggcaaggc

SEQ ID NO: 231 - DNA, 495 bp, Artificial Sequence
  source: /note="Description of Artificial Sequence: Synthetic polynucleotide"
gcctccctcgcgccatcagcactgtacgcatctgacgcacaaaaacccgagcgcagtctcgtccccggtcccccggcggccccagcttacccagcactgagagccgggtcccggcgccgaagtactgaatgttttgtcgaccactgtacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcactgtacgcatctgactgagcgggctggcaaggc

SEQ ID NO: 232 - DNA, 495 bp, Artificial Sequence
  source: /note="Description of Artificial Sequence: Synthetic polynucleotide"
gcctccctcgcgccatcaggatgatccgcatctgaccccgcaaaaaccagacccaagccgcccgcgcccgcgccccagcagcccgcgctcaccgagcaccaggagccgcgtgcctggcccgaagtactgggtctcgtcgacgatgatccgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggatgatccgcatctgactgagcgggctggcaaggc

SEQ ID NO: 233 - DNA, 495 bp, Artificial Sequence
  source: /note="Description of Artificial Sequence: Synthetic polynucleotide"
gcctccctcgcgccatcagcgccaatagcatctgaccgccgccttccacctgaatcccgccgcccgggtggtcccgcgaaaactcacccagcacggtcagcctgctgccggccccgaaagtcaggacgttggcccgtcgaccgccaatagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgccaatagcatctgactgagcgggctggcaaggc

SEQ ID NO: 234 - DNA, 495 bp, Artificial Sequence
  source: /note="Description of Artificial Sequence: Synthetic polynucleotide"
gcctccctcgcgccatcagtcaagcctgcatctgaccaccctccgactccggggaccgaggggctggaaggtggggagacgcccgaatctcacctgtgaccgtgagcctggtgcccggcccgaagtactgctcgtgtcgactcaagcctgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtcaagcctgcatctgactgagcgggctggcaaggc

SEQ ID NO: 235 - DNA, 495 bp, Artificial Sequence
  source: /note="Description of Artificial Sequence: Synthetic polynucleotide"
gcctccctcgcgccatcagagagtgtctgctacacctgtggacccacttttccctgtgacggatctgcaaaagaacctgaaaaatgtcttacctacaactgtgagtctggtgccttgtccaaagaaagcttcagtgtcgacagagtgtctgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagagagtgtctgctacacctgagcgggctggcaaggc

SEQ ID NO: 236 - DNA, 495 bp, Artificial Sequence
  source: /note="Description of Artificial Sequence: Synthetic polynucleotide"
gcctccctcgcgccatcaggttccgaatgctacacatttcccaggacagagtcctccctcatcgcacccctcctagagacccccagccttacctacaacggttaacctggtccccgaaccgaaggtgtagccatagtcgacgttccgaatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggttccgaatgctacacctgagcgggctggcaaggc

SEQ ID NO: 237 - DNA, 495 bp, Artificial Sequence
  source: /note="Description of Artificial Sequence: Synthetic polynucleotide"
gcctccctcgcgccatcagcgttactttgctacacctggattccagcccctttttgcaagttcccagctgtccagccttgacttactcacctacaacagtgagccaacttccctctccaaaatatatggtgtttcgtcgaccgttactttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcgttactttgctacacctgagcgggctggcaaggc

SEQ ID NO: 238 - DNA, 495 bp, Artificial Sequence
  source: /note="Description of Artificial Sequence: Synthetic polynucleotide"
gcctccctcgcgccatcagtaggagactgctacacctcctggaactccgaccttatgatacactatcccgaaagaagtcttttacatacccaagacagagagctgggttccactgccaaaaaacagtttttcattgtcgactaggagactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagtaggagactgctacacctgagcgggctggcaaggc

SEQ ID NO: 239 - DNA, 495 bp, Artificial Sequence
  source: /note="Description of Artificial Sequence: Synthetic polynucleotide"
gcctccctcgcgccatcaggacactcttgctacacagagaactctgccttcaagggacaatggccataccaccctgattctgcaacttacctaggatggagagtcgagtcccatcaccaaaatgctggggctgatgtcgacgacactcttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggacactcttgctacacctgagcgggctggcaaggc

SEQ ID NO: 240 - DNA, 495 bp, Artificial Sequence
  source: /note="Description of Artificial Sequence: Synthetic polynucleotide"
gcctccctcgcgccatcagttcggaactgctacacatcattgcagtcaaacccaggcacccccgagtcaagagtggagcccccatacctgtcacagtgagcctggtcccgttcccaaagtggaggggtgaattatgtcgacttcggaactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagttcggaactgctacacctgagcgggctggcaaggc

SEQ ID NO: 241 - DNA, 495 bp, Artificial Sequence
  source: /note="Description of Artificial Sequence: Synthetic polynucleotide"
gcctccctcgcgccatcagaagtaacgtgctacacgggtcgtgcaggctgggctgctcaccctctctcccacctggagcccccttcttacctagcacggtgagccgtgtccctggcccgaagaactgctcattgtgtcgacaagtaacgtgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagaagtaacgtgctacacctgagcgggctggcaaggc

SEQ ID NO: 242 - DNA, 495 bp, Artificial Sequence
  source: /note="Description of Artificial Sequence: Synthetic polynucleotide"
gcctccctcgcgccatcaggtctcctatgctacaccctctgcccatcccgccctctcggagctctccggagccccaaccgcctccttacccagtacggtcagcctagagccttctccaaaaaacagctccccggtgtcgacgtctcctatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggtctcctatgctacacctgagcgggctggcaaggc

SEQ ID NO: 243 - DNA, 495 bp, Artificial Sequence
  source: /note="Description of Artificial Sequence: Synthetic polynucleotide"
gcctccctcgcgccatcaggtagacactgctacacgcgtcccggggcgccccctccccagttccggggcttcagcgggagcccccgcttaccgagcactgtcagccgggtgcctgggccaaaatactgcgtatctgtcgacgtagacactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggtagacactgctacacctgagcgggctggcaaggc

SEQ ID NO: 244 - DNA, 495 bp, Artificial Sequence
  source: /note="Description of Artificial Sequence: Synthetic polynucleotide"
gcctccctcgcgccatcagcactgtactgctacaccgcacaaaaacccgagcgcagtctcgtccccggtcccccggcggccccagcttacccagcactgagagccgggtcccggcgccgaagtactgaatgttttgtcgaccactgtactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcactgtactgctacacctgagcgggctggcaaggc

SEQ ID NO: 245 - DNA, 495 bp, Artificial Sequence
  source: /note="Description of Artificial Sequence: Synthetic polynucleotide"
gcctccctcgcgccatcaggatgatcctgctacacccccgcaaaaaccagacccaagccgcccgcgcccgcgccccagcagcccgcgctcaccgagcaccaggagccgcgtgcctggcccgaagtactgggtctcgtcgacgatgatcctgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggatgatcctgctacacctgagcgggctggcaaggc

SEQ ID NO: 246 - DNA, 495 bp, Artificial Sequence
  source: /note="Description of Artificial Sequence: Synthetic polynucleotide"
gcctccctcgcgccatcagcgccaatatgctacacccgccgccttccacctgaatcccgccgcccgggtggtcccgcgaaaactcacccagcacggtcagcctgctgccggccccgaaagtcaggacgttggcccgtcgaccgccaatatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcgccaatatgctacacctgagcgggctggcaaggc

SEQ ID NO: 247 - DNA, 495 bp, Artificial Sequence
  source: /note="Description of Artificial Sequence: Synthetic polynucleotide"
gcctccctcgcgccatcagtcaagccttgctacacccaccctccgactccggggaccgaggggctggaaggtggggagacgcccgaatctcacctgtgaccgtgagcctggtgcccggcccgaagtactgctcgtgtcgactcaagccttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagtcaagccttgctacacctgagcgggctggcaaggc

SEQ ID NO: 248 - DNA, 495 bp, Artificial Sequence
  source: /note="Description of Artificial Sequence: Synthetic polynucleotide"
gcctccctcgcgccatcagagagtgtcaactgccactgtggacccacttttccctgtgacggatctgcaaaagaacctgaaaaatgtcttacctacaactgtgagtctggtgccttgtccaaagaaagcttcagtgtcgacagagtgtcaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagagagtgtcaactgccactgagcgggctggcaaggc

SEQ ID NO: 249 - DNA, 495 bp, Artificial Sequence
  source: /note="Description of Artificial Sequence: Synthetic polynucleotide"
gcctccctcgcgccatcaggttccgaaaactgccaatttcccaggacagagtcctccctcatcgcacccctcctagagacccccagccttacctacaacggttaacctggtccccgaaccgaaggtgtagccatagtcgacgttccgaaaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggttccgaaaactgccactgagcgggctggcaaggc

SEQ ID NO: 250 - DNA, 495 bp, Artificial Sequence
  source: /note="Description of Artificial Sequence: Synthetic polynucleotide"
gcctccctcgcgccatcagcgttacttaactgccactggattccagcccctttttgcaagttcccagctgtccagccttgacttactcacctacaacagtgagccaacttccctctccaaaatatatggtgtttcgtcgaccgttacttaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcgttacttaactgccactgagcgggctggcaaggc

SEQ ID NO: 251 - DNA, 495 bp, Artificial Sequence
  source: /note="Description of Artificial Sequence: Synthetic polynucleotide"
gcctccctcgcgccatcagtaggagacaactgccactcctggaactccgaccttatgatacactatcccgaaagaagtcttttacatacccaagacagagagctgggttccactgccaaaaaacagtttttcattgtcgactaggagacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagtaggagacaactgccactgagcgggctggcaaggc

SEQ ID NO: 252 - DNA, 495 bp, Artificial Sequence
  source: /note="Description of Artificial Sequence: Synthetic polynucleotide"
gcctccctcgcgccatcaggacactctaactgccaagagaactctgccttcaagggacaatggccataccaccctgattctgcaacttacctaggatggagagtcgagtcccatcaccaaaatgctggggctgatgtcgacgacactctaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggacactctaactgccactgagcgggctggcaaggc

SEQ ID NO: 253 - DNA, 495 bp, Artificial Sequence
  source: /note="Description of Artificial Sequence: Synthetic polynucleotide"
gcctccctcgcgccatcagttcggaacaactgccaatcattgcagtcaaacccaggcacccccgagtcaagagtggagcccccatacctgtcacagtgagcctggtcccgttcccaaagtggaggggtgaattatgtcgacttcggaacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagttcggaacaactgccactgagcgggctggcaaggc

SEQ ID NO: 254 - DNA, 495 bp, Artificial Sequence
  source: /note="Description of Artificial Sequence: Synthetic polynucleotide"
gcctccctcgcgccatcagaagtaacgaactgccagggtcgtgcaggctgggctgctcaccctctctcccacctggagcccccttcttacctagcacggtgagccgtgtccctggcccgaagaactgctcattgtgtcgacaagtaacgaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagaagtaacgaactgccactgagcgggctggcaaggc

SEQ ID NO: 255 - DNA, 495 bp, Artificial Sequence
  source: /note="Description of Artificial Sequence: Synthetic polynucleotide"
gcctccctcgcgccatcaggtctcctaaactgccacctctgcccatcccgccctctcggagctctccggagccccaaccgcctccttacccagtacggtcagcctagagccttctccaaaaaacagctccccggtgtcgacgtctcctaaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggtctcctaaactgccactgagcgggctggcaaggc

SEQ ID NO: 256 - DNA, 495 bp, Artificial Sequence
  source: /note="Description of Artificial Sequence: Synthetic polynucleotide"
gcctccctcgcgccatcaggtagacacaactgccagcgtcccggggcgccccctccccagttccggggcttcagcgggagcccccgcttaccgagcactgtcagccgggtgcctgggccaaaatactgcgtatctgtcgacgtagacacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggtagacacaactgccactgagcgggctggcaaggc

SEQ ID NO: 257 - DNA, 495 bp, Artificial Sequence
  source: /note="Description of Artificial Sequence: Synthetic polynucleotide"
gcctccctcgcgccatcagcactgtacaactgccacgcacaaaaacccgagcgcagtctcgtccccggtcccccggcggccccagcttacccagcactgagagccgggtcccggcgccgaagtactgaatgttttgtcgaccactgtacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcactgtacaactgccactgagcgggctggcaaggc

SEQ ID NO: 258 - DNA, 495 bp, Artificial Sequence
  source: /note="Description of Artificial Sequence: Synthetic polynucleotide"
gcctccctcgcgccatcaggatgatccaactgccaccccgcaaaaaccagacccaagccgcccgcgcccgcgccccagcagcccgcgctcaccgagcaccaggagccgcgtgcctggcccgaagtactgggtctcgtcgacgatgatccaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggatgatccaactgccactgagcgggctggcaaggc

SEQ ID NO: 259 - DNA, 495 bp, Artificial Sequence
  source: /note="Description of Artificial Sequence: Synthetic polynucleotide"
gcctccctcgcgccatcagcgccaataaactgccaccgccgccttccacctgaatcccgccgcccgggtggtcccgcgaaaactcacccagcacggtcagcctgctgccggccccgaaagtcaggacgttggcccgtcgaccgccaataaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcgccaataaactgccactgagcgggctggcaaggc

SEQ ID NO: 260 - DNA, 495 bp, Artificial Sequence
  source: /note="Description of Artificial Sequence: Synthetic polynucleotide"
gcctccctcgcgccatcagtcaagcctaactgccaccaccctccgactccggggaccgaggggctggaaggtggggagacgcccgaatctcacctgtgaccgtgagcctggtgcccggcccgaagtactgctcgtgtcgactcaagcctaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagtcaagcctaactgccactgagcgggctggcaaggc

SEQ ID NO: 261 - DNA, 495 bp, Artificial Sequence
  source: /note="Description of Artificial Sequence: Synthetic polynucleotide"
gcctccctcgcgccatcagagagtgtcttggactgctgtggacccacttttccctgtgacggatctgcaaaagaacctgaaaaatgtcttacctacaactgtgagtctggtgccttgtccaaagaaagcttcagtgtcgacagagtgtcttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagagagtgtcttggactgctgagcgggctggcaaggc

SEQ ID NO: 262 - DNA, 495 bp, Artificial Sequence
  source: /note="Description of Artificial Sequence: Synthetic polynucleotide"
gcctccctcgcgccatcaggttccgaattggactgatttcccaggacagagtcctccctcatcgcacccctcctagagacccccagccttacctacaacggttaacctggtccccgaaccgaaggtgtagccatagtcgacgttccgaattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggttccgaattggactgctgagcgggctggcaaggc

SEQ ID NO: 263 - DNA, 495 bp, Artificial Sequence
  source: /note="Description of Artificial Sequence: Synthetic polynucleotide"
gcctccctcgcgccatcagcgttacttttggactgctggattccagcccctttttgcaagttcccagctgtccagccttgacttactcacctacaacagtgagccaacttccctctccaaaatatatggtgtttcgtcgaccgttacttttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcgttacttttggactgctgagcgggctggcaaggc

SEQ ID NO: 264 - DNA, 495 bp, Artificial Sequence
  source: /note="Description of Artificial Sequence: Synthetic polynucleotide"
gcctccctcgcgccatcagtaggagacttggactgctcctggaactccgaccttatgatacactatcccgaaagaagtcttttacatacccaagacagagagctgggttccactgccaaaaaacagtttttcattgtcgactaggagacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagtaggagacttggactgctgagcgggctggcaaggc

SEQ ID NO: 265 - DNA, 495 bp, Artificial Sequence
  source: /note="Description of Artificial Sequence: Synthetic polynucleotide"
gcctccctcgcgccatcaggacactctttggactgagagaactctgccttcaagggacaatggccataccaccctgattctgcaacttacctaggatggagagtcgagtcccatcaccaaaatgctggggctgatgtcgacgacactctttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggacactctttggactgctgagcgggctggcaaggc

SEQ ID NO: 266 - DNA, 495 bp, Artificial Sequence
  source: /note="Description of Artificial Sequence: Synthetic polynucleotide"
gcctccctcgcgccatcagttcggaacttggactgatcattgcagtcaaacccaggcacccccgagtcaagagtggagcccccatacctgtcacagtgagcctggtcccgttcccaaagtggaggggtgaattatgtcgacttcggaacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagttcggaacttggactgctgagcgggctggcaaggc

SEQ ID NO: 267 - DNA, 495 bp, Artificial Sequence
  source: /note="Description of Artificial Sequence: Synthetic polynucleotide"
gcctccctcgcgccatcagaagtaacgttggactggggtcgtgcaggctgggctgctcaccctctctcccacctggagcccccttcttacctagcacggtgagccgtgtccctggcccgaagaactgctcattgtgtcgacaagtaacgttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagaagtaacgttggactgctgagcgggctggcaaggc

SEQ ID NO: 268 - DNA, 495 bp, Artificial Sequence
  source: /note="Description of Artificial Sequence: Synthetic polynucleotide"
gcctccctcgcgccatcaggtctcctattggactgcctctgcccatcccgccctctcggagctctccggagccccaaccgcctccttacccagtacggtcagcctagagccttctccaaaaaacagctccccggtgtcgacgtctcctattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggtctcctattggactgctgagcgggctggcaaggc

SEQ ID NO: 269 - DNA, 495 bp, Artificial Sequence
  source: /note="Description of Artificial Sequence: Synthetic polynucleotide"
gcctccctcgcgccatcaggtagacacttggactggcgtcccggggcgccccctccccagttccggggcttcagcgggagcccccgcttaccgagcactgtcagccgggtgcctgggccaaaatactgcgtatctgtcgacgtagacacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggtagacacttggactgctgagcgggctggcaaggc

SEQ ID NO: 270 - DNA, 495 bp, Artificial Sequence
  source: /note="Description of Artificial Sequence: Synthetic polynucleotide"
gcctccctcgcgccatcagcactgtacttggactgcgcacaaaaacccgagcgcagtctcgtccccggtcccccggcggccccagcttacccagcactgagagccgggtcccggcgccgaagtactgaatgttttgtcgaccactgtacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcactgtacttggactgctgagcgggctggcaaggc

SEQ ID NO: 271 - DNA, 495 bp, Artificial Sequence
  source: /note="Description of Artificial Sequence: Synthetic polynucleotide"
gcctccctcgcgccatcaggatgatccttggactgccccgcaaaaaccagacccaagccgcccgcgcccgcgccccagcagcccgcgctcaccgagcaccaggagccgcgtgcctggcccgaagtactgggtctcgtcgacgatgatccttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggatgatccttggactgctgagcgggctggcaaggc

SEQ ID NO: 272 - DNA, 495 bp, Artificial Sequence
  source: /note="Description of Artificial Sequence: Synthetic polynucleotide"
gcctccctcgcgccatcagcgccaatattggactgccgccgccttccacctgaatcccgccgcccgggtggtcccgcgaaaactcacccagcacggtcagcctgctgccggccccgaaagtcaggacgttggcccgtcgaccgccaatattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcgccaatattggactgctgagcgggctggcaaggc

SEQ ID NO: 273 - DNA, 495 bp, Artificial Sequence
  source: /note="Description of Artificial Sequence: Synthetic polynucleotide"
gcctccctcgcgccatcagtcaagcctttggactgccaccctccgactccggggaccgaggggctggaaggtggggagacgcccgaatctcacctgtgaccgtgagcctggtgcccggcccgaagtactgctcgtgtcgactcaagcctttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagtcaagcctttggactgctgagcgggctggcaaggc

SEQ ID NO: 274 - DNA, 495 bp, Artificial Sequence
  source: /note="Description of Artificial Sequence: Synthetic polynucleotide"
gcctccctcgcgccatcagagagtgtccgtacgtactgtggacccacttttccctgtgacggatctgcaaaagaacctgaaaaatgtcttacctacaactgtgagtctggtgccttgtccaaagaaagcttcagtgtcgacagagtgtccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagagagtgtccgtacgtactgagcgggctggcaaggc

SEQ ID NO: 275 - DNA, 495 bp, Artificial Sequence
  source: /note="Description of Artificial Sequence: Synthetic polynucleotide"
gcctccctcgcgccatcaggttccgaacgtacgtaatttcccaggacagagtcctccctcatcgcacccctcctagagacccccagccttacctacaacggttaacctggtccccgaaccgaaggtgtagccatagtcgacgttccgaacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggttccgaacgtacgtactgagcgggctggcaaggc

SEQ ID NO: 276 - DNA, 495 bp, Artificial Sequence
  source: /note="Description of Artificial Sequence: Synthetic polynucleotide"
gcctccctcgcgccatcagcgttacttcgtacgtactggattccagcccctttttgcaagttcccagctgtccagccttgacttactcacctacaacagtgagccaacttccctctccaaaatatatggtgtttcgtcgaccgttacttcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcgttacttcgtacgtactgagcgggctggcaaggc

SEQ ID NO: 277 - DNA, 495 bp, Artificial Sequence
  source: /note="Description of Artificial Sequence: Synthetic polynucleotide"
gcctccctcgcgccatcagtaggagaccgtacgtactcctggaactccgaccttatgatacactatcccgaaagaagtcttttacatacccaagacagagagctgggttccactgccaaaaaacagtttttcattgtcgactaggagaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagtaggagaccgtacgtactgagcgggctggcaaggc

SEQ ID NO: 278 - DNA, 495 bp, Artificial Sequence
  source: /note="Description of Artificial Sequence: Synthetic polynucleotide"
gcctccctcgcgccatcaggacactctcgtacgtaagagaactctgccttcaagggacaatggccataccaccctgattctgcaacttacctaggatggagagtcgagtcccatcaccaaaatgctggggctgatgtcgacgacactctcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggacactctcgtacgtactgagcgggctggcaaggc

SEQ ID NO: 279 - DNA, 495 bp, Artificial Sequence
  source: /note="Description of Artificial Sequence: Synthetic polynucleotide"
gcctccctcgcgccatcagttcggaaccgtacgtaatcattgcagtcaaacccaggcacccccgagtcaagagtggagcccccatacctgtcacagtgagcctggtcccgttcccaaagtggaggggtgaattatgtcgacttcggaaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagttcggaaccgtacgtactgagcgggctggcaaggc

SEQ ID NO: 280 - DNA, 495 bp, Artificial Sequence
  source: /note="Description of Artificial Sequence: Synthetic polynucleotide"
gcctccctcgcgccatcagaagtaacgcgtacgtagggtcgtgcaggctgggctgctcaccctctctcccacctggagcccccttcttacctagcacggtgagccgtgtccctggcccgaagaactgctcattgtgtcgacaagtaacgcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagaagtaacgcgtacgtactgagcgggctggcaaggc

SEQ ID NO: 281 - DNA, 495 bp, Artificial Sequence
  source: /note="Description of Artificial Sequence: Synthetic polynucleotide"
gcctccctcgcgccatcaggtctcctacgtacgtacctctgcccatcccgccctctcggagctctccggagccccaaccgcctccttacccagtacggtcagcctagagccttctccaaaaaacagctccccggtgtcgacgtctcctacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggtctcctacgtacgtactgagcgggctggcaaggc

SEQ ID NO: 282 - DNA, 495 bp, Artificial Sequence
  source: /note="Description of Artificial Sequence: Synthetic polynucleotide"
gcctccctcgcgccatcaggtagacaccgtacgtagcgtcccggggcgccccctccccagttccggggcttcagcgggagcccccgcttaccgagcactgtcagccgggtgcctgggccaaaatactgcgtatctgtcgacgtagacaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggtagacaccgtacgtactgagcgggctggcaaggc

SEQ ID NO: 283 - DNA, 495 bp, Artificial Sequence
  source: /note="Description of Artificial Sequence: Synthetic polynucleotide"
gcctccctcgcgccatcagcactgtaccgtacgtacgcacaaaaacccgagcgcagtctcgtccccggtcccccggcggccccagcttacccagcactgagagccgggtcccggcgccgaagtactgaatgttttgtcgaccactgtaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcactgtaccgtacgtactgagcgggctggcaaggc

SEQ ID NO: 284 - DNA, 495 bp, Artificial Sequence
  source: /note="Description of Artificial Sequence: Synthetic polynucleotide"
gcctccctcgcgccatcaggatgatcccgtacgtaccccgcaaaaaccagacccaagccgcccgcgcccgcgccccagcagcccgcgctcaccgagcaccaggagccgcgtgcctggcccgaagtactgggtctcgtcgacgatgatcccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggatgatcccgtacgtactgagcgggctggcaaggc

SEQ ID NO: 285 - DNA, 495 bp, Artificial Sequence
  source: /note="Description of Artificial Sequence: Synthetic polynucleotide"
gcctccctcgcgccatcagcgccaatacgtacgtaccgccgccttccacctgaatcccgccgcccgggtggtcccgcgaaaactcacccagcacggtcagcctgctgccggccccgaaagtcaggacgttggcccgtcgaccgccaatacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcgccaatacgtacgtactgagcgggctggcaaggc

SEQ ID NO: 286 - DNA, 495 bp, Artificial Sequence
  source: /note="Description of Artificial Sequence: Synthetic polynucleotide"
gcctccctcgcgccatcagtcaagcctcgtacgtaccaccctccgactccggggaccgaggggctggaaggtggggagacgcccgaatctcacctgtgaccgtgagcctggtgcccggcccgaagtactgctcgtgtcgactcaagcctcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagtcaagcctcgtacgtactgagcgggctggcaaggc

SEQ ID NO: 287 - DNA, 495 bp, Artificial Sequence
  source: /note="Description of Artificial Sequence: Synthetic polynucleotide"
gcctccctcgcgccatcagagagtgtctcggtactctgtggacccacttttccctgtgacggatctgcaaaagaacctgaaaaatgtcttacctacaactgtgagtctggtgccttgtccaaagaaagcttcagtgtcgacagagtgtctcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacagagtgtctcggtactctgagcgggctggcaaggc

SEQ ID NO: 288 - DNA, 495 bp, Artificial Sequence
  source: /note="Description of Artificial Sequence: Synthetic polynucleotide"
gcctccctcgcgccatcaggttccgaatcggtactatttcccaggacagagtcctccctcatcgcacccctcctagagacccccagccttacctacaacggttaacctggtccccgaaccgaaggtgtagccatagtcgacgttccgaatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgttccgaatcggtactctgagcgggctggcaaggc

SEQ ID NO: 289 - DNA, 495 bp, Artificial Sequence
  source: /note="Description of Artificial Sequence: Synthetic polynucleotide"
gcctccctcgcgccatcagcgttactttcggtactctggattccagcccctttttgcaagttcccagctgtccagccttgacttactcacctacaacagtgagccaacttccctctccaaaatatatggtgtttcgtcgaccgttactttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccgttactttcggtactctgagcgggctggcaaggc

SEQ ID NO: 290 - DNA, 495 bp, Artificial Sequence
  source: /note="Description of Artificial Sequence: Synthetic polynucleotide"
gcctccctcgcgccatcagtaggagactcggtactctcctggaactccgaccttatgatacactatcccgaaagaagtcttttacatacccaagacagagagctgggttccactgccaaaaaacagtttttcattgtcgactaggagactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaactaggagactcggtactctgagcgggctggcaaggc

SEQ ID NO: 291 - DNA, 495 bp, Artificial Sequence
  source: /note="Description of Artificial Sequence: Synthetic polynucleotide"
gcctccctcgcgccatcaggacactcttcggtactagagaactctgccttcaagggacaatggccataccaccctgattctgcaacttacctaggatggagagtcgagtcccatcaccaaaatgctggggctgatgtcgacgacactcttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgacactcttcggtactctgagcgggctggcaaggc

SEQ ID NO: 292 - DNA, 495 bp, Artificial Sequence
  source: /note="Description of Artificial Sequence: Synthetic polynucleotide"
gcctccctcgcgccatcagttcggaactcggtactatcattgcagtcaaacccaggcacccccgagtcaagagtggagcccccatacctgtcacagtgagcctggtcccgttcccaaagtggaggggtgaattatgtcgacttcggaactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacttcggaactcggtactctgagcgggctggcaaggc

SEQ ID NO: 293 - DNA, 495 bp, Artificial Sequence
  source: /note="Description of Artificial Sequence: Synthetic polynucleotide"
gcctccctcgcgccatcagaagtaacgtcggtactgggtcgtgcaggctgggctgctcaccctctctcccacctggagcccccttcttacctagcacggtgagccgtgtccctggcccgaagaactgctcattgtgtcgacaagtaacgtcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacaagtaacgtcggtactctgagcgggctggcaaggc

SEQ ID NO: 294 - DNA, 495 bp, Artificial Sequence
  source: /note="Description of Artificial Sequence: Synthetic polynucleotide"
gcctccctcgcgccatcaggtctcctatcggtactcctctgcccatcccgccctctcggagctctccggagccccaaccgcctccttacccagtacggtcagcctagagccttctccaaaaaacagctccccggtgtcgacgtctcctatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgtctcctatcggtactctgagcgggctggcaaggc

SEQ ID NO: 295 - DNA, 495 bp, Artificial Sequence
  source: /note="Description of Artificial Sequence: Synthetic polynucleotide"
gcctccctcgcgccatcaggtagacactcggtactgcgtcccggggcgccccctccccagttccggggcttcagcgggagcccccgcttaccgagcactgtcagccgggtgcctgggccaaaatactgcgtatctgtcgacgtagacactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgtagacactcggtactctgagcgggctggcaaggc

SEQ ID NO: 296 - DNA, 495 bp, Artificial Sequence
  source: /note="Description of Artificial Sequence: Synthetic polynucleotide"
gcctccctcgcgccatcagcactgtactcggtactcgcacaaaaacccgagcgcagtctcgtccccggtcccccggcggccccagcttacccagcactgagagccgggtcccggcgccgaagtactgaatgttttgtcgaccactgtactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccactgtactcggtactctgagcgggctggcaaggc

SEQ ID NO: 297 - DNA, 495 bp, Artificial Sequence
  source: /note="Description of Artificial Sequence: Synthetic polynucleotide"
gcctccctcgcgccatcaggatgatcctcggtactccccgcaaaaaccagacccaagccgcccgcgcccgcgccccagcagcccgcgctcaccgagcaccaggagccgcgtgcctggcccgaagtactgggtctcgtcgacgatgatcctcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgatgatcctcggtactctgagcgggctggcaaggc

SEQ ID NO: 298 - DNA, 495 bp, Artificial Sequence
  source: /note="Description of Artificial Sequence: Synthetic polynucleotide"
gcctccctcgcgccatcagcgccaatatcggtactccgccgccttccacctgaatcccgccgcccgggtggtcccgcgaaaactcacccagcacggtcagcctgctgccggccccgaaagtcaggacgttggcccgtcgaccgccaatatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccgccaatatcggtactctgagcgggctggcaaggc

SEQ ID NO: 299 - DNA, 495 bp, Artificial Sequence
  source: /note="Description of Artificial Sequence: Synthetic polynucleotide"
gcctccctcgcgccatcagtcaagccttcggtactccaccctccgactccggggaccgaggggctggaaggtggggagacgcccgaatctcacctgtgaccgtgagcctggtgcccggcccgaagtactgctcgtgtcgactcaagccttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaactcaagccttcggtactctgagcgggctggcaaggc

SEQ ID NO: 300 - DNA, 495 bp, Artificial Sequence
  source: /note="Description of Artificial Sequence: Synthetic polynucleotide"
gcctccctcgcgccatcagagagtgtcccatggatctgtggacccacttttccctgtgacggatctgcaaaagaacctgaaaaatgtcttacctacaactgtgagtctggtgccttgtccaaagaaagcttcagtgtcgacagagtgtcccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagagagtgtcccatggatctgagcgggctggcaaggc

SEQ ID NO: 301 - DNA, 495 bp, Artificial Sequence
  source: /note="Description of Artificial Sequence: Synthetic polynucleotide"
gcctccctcgcgccatcaggttccgaaccatggatatttcccaggacagagtcctccctcatcgcacccctcctagagacccccagccttacctacaacggttaacctggtccccgaaccgaaggtgtagccatagtcgacgttccgaaccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggttccgaaccatggatctgagcgggctggcaaggc

SEQ ID NO: 302 - DNA, 495 bp, Artificial Sequence
  source: /note="Description of Artificial Sequence: Synthetic polynucleotide"
gcctccctcgcgccatcagcgttacttccatggatctggattccagcccctttttgcaagttcccagctgtccagccttgacttactcacctacaacagtgagccaacttccctctccaaaatatatggtgtttcgtcgaccgttacttccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcgttacttccatggatctgagcgggctggcaaggc

SEQ ID NO: 303 - DNA, 495 bp, Artificial Sequence
  source: /note="Description of Artificial Sequence: Synthetic polynucleotide"
gcctccctcgcgccatcagtaggagacccatggatctcctggaactccgaccttatgatacactatcccgaaagaagtcttttacatacccaagacagagagctgggttccactgccaaaaaacagtttttcattgtcgactaggagacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagtaggagacccatggatctgagcgggctggcaaggc

SEQ ID NO: 304 - DNA, 495 bp, Artificial Sequence
  source: /note="Description of Artificial Sequence: Synthetic polynucleotide"
gcctccctcgcgccatcaggacactctccatggatagagaactctgccttcaagggacaatggccataccaccctgattctgcaacttacctaggatggagagtcgagtcccatcaccaaaatgctggggctgatgtcgacgacactctccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggacactctccatggatctgagcgggctggcaaggc

SEQ ID NO: 305 - DNA, 495 bp, Artificial Sequence
  source: /note="Description of Artificial Sequence: Synthetic polynucleotide"
gcctccctcgcgccatcagttcggaacccatggatatcattgcagtcaaacccaggcacccccgagtcaagagtggagcccccatacctgtcacagtgagcctggtcccgttcccaaagtggaggggtgaattatgtcgacttcggaacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagttcggaacccatggatctgagcgggctggcaaggc

SEQ ID NO: 306 - DNA, 495 bp, Artificial Sequence
  source: /note="Description of Artificial Sequence: Synthetic polynucleotide"
gcctccctcgcgccatcagaagtaacgccatggatgggtcgtgcaggctgggctgctcaccctctctcccacctggagcccccttcttacctagcacggtgagccgtgtccctggcccgaagaactgctcattgtgtcgacaagtaacgccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagaagtaacgccatggatctgagcgggctggcaaggc

SEQ ID NO: 307 - DNA, 495 bp, Artificial Sequence
  source: /note="Description of Artificial Sequence: Synthetic polynucleotide"
gcctccctcgcgccatcaggtctcctaccatggatcctctgcccatcccgccctctcggagctctccggagccccaaccgcctccttacccagtacggtcagcctagagccttctccaaaaaacagctccccggtgtcgacgtctcctaccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggtctcctaccatggatctgagcgggctggcaaggc

SEQ ID NO: 308 - DNA, 495 bp, Artificial Sequence
  source: /note="Description of Artificial Sequence: Synthetic polynucleotide"
gcctccctcgcgccatcaggtagacacccatggatgcgtcccggggcgccccctccccagttccggggcttcagcgggagcccccgcttaccgagcactgtcagccgggtgcctgggccaaaatactgcgtatctgtcgacgtagacacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggtagacacccatggatctgagcgggctggcaaggc

SEQ ID NO: 309 - DNA, 495 bp, Artificial Sequence
  source: /note="Description of Artificial Sequence: Synthetic polynucleotide"
gcctccctcgcgccatcagcactgtacccatggatcgcacaaaaacccgagcgcagtctcgtccccggtcccccggcggccccagcttacccagcactgagagccgggtcccggcgccgaagtactgaatgttttgtcgaccactgtacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcactgtacccatggatctgagcgggctggcaaggc

SEQ ID NO: 310 - DNA, 495 bp, Artificial Sequence
  source: /note="Description of Artificial Sequence: Synthetic polynucleotide"
gcctccctcgcgccatcaggatgatccccatggatccccgcaaaaaccagacccaagccgcccgcgcccgcgccccagcagcccgcgctcaccgagcaccaggagccgcgtgcctggcccgaagtactgggtctcgtcgacgatgatccccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggatgatccccatggatctgagcgggctggcaaggc

SEQ ID NO: 311 - DNA, 495 bp, Artificial Sequence
  source: /note="Description of Artificial Sequence: Synthetic polynucleotide"
gcctccctcgcgccatcagcgccaataccatggatccgccgccttccacctgaatcccgccgcccgggtggtcccgcgaaaactcacccagcacggtcagcctgctgccggccccgaaagtcaggacgttggcccgtcgaccgccaataccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcgccaataccatggatctgagcgggctggcaaggc

SEQ ID NO: 312 - DNA, 495 bp, Artificial Sequence
  source: /note="Description of Artificial Sequence: Synthetic polynucleotide"
gcctccctcgcgccatcagtcaagcctccatggatccaccctccgactccggggaccgaggggctggaaggtggggagacgcccgaatctcacctgtgaccgtgagcctggtgcccggcccgaagtactgctcgtgtcgactcaagcctccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagtcaagcctccatggatctgagcgggctggcaaggc

SEQ ID NO: 313 - DNA, 495 bp, Artificial Sequence
  source: /note="Description of Artificial Sequence: Synthetic polynucleotide"
gcctccctcgcgccatcagagagtgtcactgctacctgtggacccacttttccctgtgacggatctgcaaaagaacctgaaaaatgtcttacctacaactgtgagtctggtgccttgtccaaagaaagcttcagtgtcgacagagtgtcactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagagagtgtcactgctacctgagcgggctggcaaggc

SEQ ID NO: 314 - DNA, 495 bp, Artificial Sequence
  source: /note="Description of Artificial Sequence: Synthetic polynucleotide"
gcctccctcgcgccatcaggttccgaaactgctacatttcccaggacagagtcctccctcatcgcacccctcctagagacccccagccttacctacaacggttaacctggtccccgaaccgaaggtgtagccatagtcgacgttccgaaactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggttccgaaactgctacctgagcgggctggcaaggc

SEQ ID NO: 315 - DNA, 495 bp, Artificial Sequence
  source: /note="Description of Artificial Sequence: Synthetic polynucleotide"
gcctccctcgcgccatcagcgttacttactgctacctggattccagcccctttttgcaagttcccagctgtccagccttgacttactcacctacaacagtgagccaacttccctctccaaaatatatggtgtttcgtcgaccgttacttactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcgttacttactgctacctgagcgggctggcaaggc

SEQ ID NO: 316 - DNA, 495 bp, Artificial Sequence
  source: /note="Description of Artificial Sequence: Synthetic polynucleotide"
gcctccctcgcgccatcagtaggagacactgctacctcctggaactccgaccttatgatacactatcccgaaagaagtcttttacatacccaagacagagagctgggttccactgccaaaaaacagtttttcattgtcgactaggagacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagtaggagacactgctacctgagcgggctggcaaggc

SEQ ID NO: 317 - DNA, 495 bp, Artificial Sequence
  source: /note="Description of Artificial Sequence: Synthetic polynucleotide"
gcctccctcgcgccatcaggacactctactgctacagagaactctgccttcaagggacaatggccataccaccctgattctgcaacttacctaggatggagagtcgagtcccatcaccaaaatgctggggctgatgtcgacgacactctactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggacactctactgctacctgagcgggctggcaaggc

SEQ ID NO: 318 - DNA, 495 bp, Artificial Sequence
  source: /note="Description of Artificial Sequence: Synthetic polynucleotide"
gcctccctcgcgccatcagttcggaacactgctacatcattgcagtcaaacccaggcacccccgagtcaagagtggagcccccatacctgtcacagtgagcctggtcccgttcccaaagtggaggggtgaattatgtcgacttcggaacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagttcggaacactgctacctgagcgggctggcaaggc

SEQ ID NO: 319 - DNA, 495 bp, Artificial Sequence
  source: /note="Description of Artificial Sequence: Synthetic polynucleotide"
gcctccctcgcgccatcagaagtaacgactgctacgggtcgtgcaggctgggctgctcaccctctctcccacctggagcccccttcttacctagcacggtgagccgtgtccctggcccgaagaactgctcattgtgtcgacaagtaacgactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagaagtaacgactgctacctgagcgggctggcaaggc

SEQ ID NO: 320 - DNA, 495 bp, Artificial Sequence
  source: /note="Description of Artificial Sequence: Synthetic polynucleotide"
gcctccctcgcgccatcaggtctcctaactgctaccctctgcccatcccgccctctcggagctctccggagccccaaccgcctccttacccagtacggtcagcctagagccttctccaaaaaacagctccccggtgtcgacgtctcctaactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggtctcctaactgctacctgagcgggctggcaaggc

SEQ ID NO: 321 - DNA, 495 bp, Artificial Sequence
  source: /note="Description of Artificial Sequence: Synthetic polynucleotide"
gcctccctcgcgccatcaggtagacacactgctacgcgtcccggggcgccccctccccagttccggggcttcagcgggagcccccgcttaccgagcactgtcagccgggtgcctgggccaaaatactgcgtatctgtcgacgtagacacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggtagacacactgctacctgagcgggctggcaaggc

SEQ ID NO: 322 - DNA, 495 bp, Artificial Sequence
  source: /note="Description of Artificial Sequence: Synthetic polynucleotide"
gcctccctcgcgccatcagcactgtacactgctaccgcacaaaaacccgagcgcagtctcgtccccggtcccccggcggccccagcttacccagcactgagagccgggtcccggcgccgaagtactgaatgttttgtcgaccactgtacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcactgtacactgctacctgagcgggctggcaaggc

SEQ ID NO: 323 - DNA, 495 bp, Artificial Sequence
  source: /note="Description of Artificial Sequence: Synthetic polynucleotide"
gcctccctcgcgccatcaggatgatccactgctacccccgcaaaaaccagacccaagccgcccgcgcccgcgccccagcagcccgcgctcaccgagcaccaggagccgcgtgcctggcccgaagtactgggtctcgtcgacgatgatccactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggatgatccactgctacctgagcgggctggcaaggc

SEQ ID NO: 324 - DNA, 495 bp, Artificial Sequence
  source: /note="Description of Artificial Sequence: Synthetic polynucleotide"
gcctccctcgcgccatcagcgccaataactgctacccgccgccttccacctgaatcccgccgcccgggtggtcccgcgaaaactcacccagcacggtcagcctgctgccggccccgaaagtcaggacgttggcccgtcgaccgccaataactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcgccaataactgctacctgagcgggctggcaaggc

SEQ ID NO: 325 - DNA, 495 bp, Artificial Sequence
  source: /note="Description of Artificial Sequence: Synthetic polynucleotide"
gcctccctcgcgccatcagtcaagcctactgctacccaccctccgactccggggaccgaggggctggaaggtggggagacgcccgaatctcacctgtgaccgtgagcctggtgcccggcccgaagtactgctcgtgtcgactcaagcctactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagtcaagcctactgctacctgagcgggctggcaaggc

SEQ ID NO: 326 - DNA, 495 bp, Artificial Sequence
  source: /note="Description of Artificial Sequence: Synthetic polynucleotide"
gcctccctcgcgccatcagagagtgtcacgaagatctgtggacccacttttccctgtgacggatctgcaaaagaacctgaaaaatgtcttacctacaactgtgagtctggtgccttgtccaaagaaagcttcagtgtcgacagagtgtcacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagagagtgtcacgaagatctgagcgggctggcaaggc

SEQ ID NO: 327 - DNA, 495 bp, Artificial Sequence
  source: /note="Description of Artificial Sequence: Synthetic polynucleotide"
gcctccctcgcgccatcaggttccgaaacgaagatatttcccaggacagagtcctccctcatcgcacccctcctagagacccccagccttacctacaacggttaacctggtccccgaaccgaaggtgtagccatagtcgacgttccgaaacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggttccgaaacgaagatctgagcgggctggcaaggc

SEQ ID NO: 328 - DNA, 495 bp, Artificial Sequence
  source: /note="Description of Artificial Sequence: Synthetic polynucleotide"
gcctccctcgcgccatcagcgttacttacgaagatctggattccagcccctttttgcaagttcccagctgtccagccttgacttactcacctacaacagtgagccaacttccctctccaaaatatatggtgtttcgtcgaccgttacttacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcgttacttacgaagatctgagcgggctggcaaggc

SEQ ID NO: 329 - DNA, 495 bp, Artificial Sequence
  source: /note="Description of Artificial Sequence: Synthetic polynucleotide"
gcctccctcgcgccatcagtaggagacacgaagatctcctggaactccgaccttatgatacactatcccgaaagaagtcttttacatacccaagacagagagctgggttccactgccaaaaaacagtttttcattgtcgactaggagacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagtaggagacacgaagatctgagcgggctggcaaggc

SEQ ID NO: 330 - DNA, 495 bp, Artificial Sequence
  source: /note="Description of Artificial Sequence: Synthetic polynucleotide"
gcctccctcgcgccatcaggacactctacgaagatagagaactctgccttcaagggacaatggccataccaccctgattctgcaacttacctaggatggagagtcgagtcccatcaccaaaatgctggggctgatgtcgacgacactctacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggacactctacgaagatctgagcgggctggcaaggc

SEQ ID NO: 331 - DNA, 495 bp, Artificial Sequence
  source: /note="Description of Artificial Sequence: Synthetic polynucleotide"
gcctccctcgcgccatcagttcggaacacgaagatatcattgcagtcaaacccaggcacccccgagtcaagagtggagcccccatacctgtcacagtgagcctggtcccgttcccaaagtggaggggtgaattatgtcgacttcggaacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagttcggaacacgaagatctgagcgggctggcaaggc

SEQ ID NO: 332 - DNA, 495 bp, Artificial Sequence
  source: /note="Description of Artificial Sequence: Synthetic polynucleotide"
gcctccctcgcgccatcagaagtaacgacgaagatgggtcgtgcaggctgggctgctcaccctctctcccacctggagcccccttcttacctagcacggtgagccgtgtccctggcccgaagaactgctcattgtgtcgacaagtaacgacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagaagtaacgacgaagatctgagcgggctggcaaggc

SEQ ID NO: 333 - DNA, 495 bp, Artificial Sequence
  source: /note="Description of Artificial Sequence: Synthetic polynucleotide"
gcctccctcgcgccatcaggtctcctaacgaagatcctctgcccatcccgccctctcggagctctccggagccccaaccgcctccttacccagtacggtcagcctagagccttctccaaaaaacagctccccggtgtcgacgtctcctaacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggtctcctaacgaagatctgagcgggctggcaaggc

SEQ ID NO: 334 - DNA, 495 bp, Artificial Sequence
  source: /note="Description of Artificial Sequence: Synthetic polynucleotide"
gcctccctcgcgccatcaggtagacacacgaagatgcgtcccggggcgccccctccccagttccggggcttcagcgggagcccccgcttaccgagcactgtcagccgggtgcctgggccaaaatactgcgtatctgtcgacgtagacacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggtagacacacgaagatctgagcgggctggcaaggc

SEQ ID NO: 335 - DNA, 495 bp, Artificial Sequence
  source: /note="Description of Artificial Sequence: Synthetic polynucleotide"
gcctccctcgcgccatcagcactgtacacgaagatcgcacaaaaacccgagcgcagtctcgtccccggtcccccggcggccccagcttacccagcactgagagccgggtcccggcgccgaagtactgaatgttttgtcgaccactgtacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcactgtacacgaagatctgagcgggctggcaaggc

SEQ ID NO: 336 - DNA, 495 bp, Artificial Sequence
  source: /note="Description of Artificial Sequence: Synthetic polynucleotide"
gcctccctcgcgccatcaggatgatccacgaagatccccgcaaaaaccagacccaagccgcccgcgcccgcgccccagcagcccgcgctcaccgagcaccaggagccgcgtgcctggcccgaagtactgggtctcgtcgacgatgatccacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggatgatccacgaagatctgagcgggctggcaaggc

SEQ ID NO: 337 - DNA, 495 bp, Artificial Sequence
  source: /note="Description of Artificial Sequence: Synthetic polynucleotide"
gcctccctcgcgccatcagcgccaataacgaagatccgccgccttccacctgaatcccgccgcccgggtggtcccgcgaaaactcacccagcacggtcagcctgctgccggccccgaaagtcaggacgttggcccgtcgaccgccaataacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcgccaataacgaagatctgagcgggctggcaaggc

SEQ ID NO: 338 - DNA, 495 bp, Artificial Sequence
  source: /note="Description of Artificial Sequence: Synthetic polynucleotide"
gcctccctcgcgccatcagtcaagcctacgaagatccaccctccgactccggggaccgaggggctggaaggtggggagacgcccgaatctcacctgtgaccgtgagcctggtgcccggcccgaagtactgctcgtgtcgactcaagcctacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagtcaagcctacgaagatctgagcgggctggcaaggc

SEQ ID NO: 339 - DNA, 495 bp, Artificial Sequence
  source: /note="Description of Artificial Sequence: Synthetic polynucleotide"
gcctccctcgcgccatcagagagtgtcactgtggactgtggacccacttttccctgtgacggatctgcaaaagaacctgaaaaatgtcttacctacaactgtgagtctggtgccttgtccaaagaaagcttcagtgtcgacagagtgtcactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagagagtgtcactgtggactgagcgggctggcaaggc

SEQ ID NO: 340 - DNA, 495 bp, Artificial Sequence
  source: /note="Description of Artificial Sequence: Synthetic polynucleotide"
gcctccctcgcgccatcaggttccgaaactgtggaatttcccaggacagagtcctccctcatcgcacccctcctagagacccccagccttacctacaacggttaacctggtccccgaaccgaaggtgtagccatagtcgacgttccgaaactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggttccgaaactgtggactgagcgggctggcaaggc

SEQ ID NO: 341 - DNA, 495 bp, Artificial Sequence
  source: /note="Description of Artificial Sequence: Synthetic polynucleotide"
gcctccctcgcgccatcagcgttacttactgtggactggattccagcccctttttgcaagttcccagctgtccagccttgacttactcacctacaacagtgagccaacttccctctccaaaatatatggtgtttcgtcgaccgttacttactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcgttacttactgtggactgagcgggctggcaaggc

SEQ ID NO: 342 - DNA, 495 bp, Artificial Sequence
  source: /note="Description of Artificial Sequence: Synthetic polynucleotide"
gcctccctcgcgccatcagtaggagacactgtggactcctggaactccgaccttatgatacactatcccgaaagaagtcttttacatacccaagacagagagctgggttccactgccaaaaaacagtttttcattgtcgactaggagacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagtaggagacactgtggactgagcgggctggcaaggc

SEQ ID NO: 343 - DNA, 495 bp, Artificial Sequence
  source: /note="Description of Artificial Sequence: Synthetic polynucleotide"
gcctccctcgcgccatcaggacactctactgtggaagagaactctgccttcaagggacaatggccataccaccctgattctgcaacttacctaggatggagagtcgagtcccatcaccaaaatgctggggctgatgtcgacgacactctactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggacactctactgtggactgagcgggctggcaaggc

SEQ ID NO: 344 - DNA, 495 bp, Artificial Sequence
  source: /note="Description of Artificial Sequence: Synthetic polynucleotide"
gcctccctcgcgccatcagttcggaacactgtggaatcattgcagtcaaacccaggcacccccgagtcaagagtggagcccccatacctgtcacagtgagcctggtcccgttcccaaagtggaggggtgaattatgtcgacttcggaacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagttcggaacactgtggactgagcgggctggcaaggc

SEQ ID NO: 345 - DNA, 495 bp, Artificial Sequence
  source: /note="Description of Artificial Sequence: Synthetic polynucleotide"
gcctccctcgcgccatcagaagtaacgactgtggagggtcgtgcaggctgggctgctcaccctctctcccacctggagcccccttcttacctagcacggtgagccgtgtccctggcccgaagaactgctcattgtgtcgacaagtaacgactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagaagtaacgactgtggactgagcgggctggcaaggc

SEQ ID NO: 346 - DNA, 495 bp, Artificial Sequence
  source: /note="Description of Artificial Sequence: Synthetic polynucleotide"
gcctccctcgcgccatcaggtctcctaactgtggacctctgcccatcccgccctctcggagctctccggagccccaaccgcctccttacccagtacggtcagcctagagccttctccaaaaaacagctccccggtgtcgacgtctcctaactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggtctcctaactgtggactgagcgggctggcaaggc

SEQ ID NO: 347 - DNA, 495 bp, Artificial Sequence
  source: /note="Description of Artificial Sequence: Synthetic polynucleotide"
gcctccctcgcgccatcaggtagacacactgtggagcgtcccggggcgccccctccccagttccggggcttcagcgggagcccccgcttaccgagcactgtcagccgggtgcctgggccaaaatactgcgtatctgtcgacgtagacacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggtagacacactgtggactgagcgggctggcaaggc

SEQ ID NO: 348 - DNA, 495 bp, Artificial Sequence
  source: /note="Description of Artificial Sequence: Synthetic polynucleotide"
gcctccctcgcgccatcagcactgtacactgtggacgcacaaaaacccgagcgcagtctcgtccccggtcccccggcggccccagcttacccagcactgagagccgggtcccggcgccgaagtactgaatgttttgtcgaccactgtacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcactgtacactgtggactgagcgggctggcaaggc

SEQ ID NO: 349 - DNA, 495 bp, Artificial Sequence
  source: /note="Description of Artificial Sequence: Synthetic polynucleotide"
gcctccctcgcgccatcaggatgatccactgtggaccccgcaaaaaccagacccaagccgcccgcgcccgcgccccagcagcccgcgctcaccgagcaccaggagccgcgtgcctggcccgaagtactgggtctcgtcgacgatgatccactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggatgatccactgtggactgagcgggctggcaaggc

SEQ ID NO: 350 - DNA, 495 bp, Artificial Sequence
  source: /note="Description of Artificial Sequence: Synthetic polynucleotide"
gcctccctcgcgccatcagcgccaataactgtggaccgccgccttccacctgaatcccgccgcccgggtggtcccgcgaaaactcacccagcacggtcagcctgctgccggccccgaaagtcaggacgttggcccgtcgaccgccaataactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcgccaataactgtggactgagcgggctggcaaggc

SEQ ID NO: 351 - DNA, 495 bp, Artificial Sequence
  source: /note="Description of Artificial Sequence: Synthetic polynucleotide"
gcctccctcgcgccatcagtcaagcctactgtggaccaccctccgactccggggaccgaggggctggaaggtggggagacgcccgaatctcacctgtgaccgtgagcctggtgcccggcccgaagtactgctcgtgtcgactcaagcctactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagtcaagcctactgtggactgagcgggctggcaaggc

SEQ ID NO: 352 - DNA, 495 bp, Artificial Sequence
  source: /note="Description of Artificial Sequence: Synthetic polynucleotide"
gcctccctcgcgccatcagagagtgtcggtgtcatctgtggacccacttttccctgtgacggatctgcaaaagaacctgaaaaatgtcttacctacaactgtgagtctggtgccttgtccaaagaaagcttcagtgtcgacagagtgtcggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaaagagtgtcggtgtcatctgagcgggctggcaaggc

SEQ ID NO: 353 - DNA, 495 bp, Artificial Sequence
  source: /note="Description of Artificial Sequence: Synthetic polynucleotide"
gcctccctcgcgccatcaggttccgaaggtgtcatatttcccaggacagagtcctccctcatcgcacccctcctagagacccccagccttacctacaacggttaacctggtccccgaaccgaaggtgtagccatagtcgacgttccgaaggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagttccgaaggtgtcatctgagcgggctggcaaggc

SEQ ID NO: 354 - DNA, 495 bp, Artificial Sequence
  source: /note="Description of Artificial Sequence: Synthetic polynucleotide"
gcctccctcgcgccatcagcgttacttggtgtcatctggattccagcccctttttgcaagttcccagctgtccagccttgacttactcacctacaacagtgagccaacttccctctccaaaatatatggtgtttcgtcgaccgttacttggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacgttacttggtgtcatctgagcgggctggcaaggc

SEQ ID NO: 355 - DNA, 495 bp, Artificial Sequence
  source: /note="Description of Artificial Sequence: Synthetic polynucleotide"
gcctccctcgcgccatcagtaggagacggtgtcatctcctggaactccgaccttatgatacactatcccgaaagaagtcttttacatacccaagacagagagctgggttccactgccaaaaaacagtttttcattgtcgactaggagacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaataggagacggtgtcatctgagcgggctggcaaggc

SEQ ID NO: 356 - DNA, 495 bp, Artificial Sequence
  source: /note="Description of Artificial Sequence: Synthetic polynucleotide"
gcctccctcgcgccatcaggacactctggtgtcatagagaactctgccttcaagggacaatggccataccaccctgattctgcaacttacctaggatggagagtcgagtcccatcaccaaaatgctggggctgatgtcgacgacactctggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagacactctggtgtcatctgagcgggctggcaaggc

SEQ ID NO: 357 - DNA, 495 bp, Artificial Sequence
  source: /note="Description of Artificial Sequence: Synthetic polynucleotide"
gcctccctcgcgccatcagttcggaacggtgtcatatcattgcagtcaaacccaggcacccccgagtcaagagtggagcccccatacctgtcacagtgagcctggtcccgttcccaaagtggaggggtgaattatgtcgacttcggaacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaattcggaacggtgtcatctgagcgggctggcaaggc

SEQ ID NO: 358 - DNA, 495 bp, Artificial Sequence
  source: /note="Description of Artificial Sequence: Synthetic polynucleotide"
gcctccctcgcgccatcagaagtaacgggtgtcatgggtcgtgcaggctgggctgctcaccctctctcccacctggagcccccttcttacctagcacggtgagccgtgtccctggcccgaagaactgctcattgtgtcgacaagtaacgggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaaaagtaacgggtgtcatctgagcgggctggcaaggc

SEQ ID NO: 359 - DNA, 495 bp, Artificial Sequence
  source: /note="Description of Artificial Sequence: Synthetic polynucleotide"
gcctccctcgcgccatcaggtctcctaggtgtcatcctctgcccatcccgccctctcggagctctccggagccccaaccgcctccttacccagtacggtcagcctagagccttctccaaaaaacagctccccggtgtcgacgtctcctaggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagtctcctaggtgtcatctgagcgggctggcaaggc

SEQ ID NO: 360 - DNA, 495 bp, Artificial Sequence
  source: /note="Description of Artificial Sequence: Synthetic polynucleotide"
gcctccctcgcgccatcaggtagacacggtgtcatgcgtcccggggcgccccctccccagttccggggcttcagcgggagcccccgcttaccgagcactgtcagccgggtgcctgggccaaaatactgcgtatctgtcgacgtagacacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagtagacacggtgtcatctgagcgggctggcaaggc

SEQ ID NO: 361 - DNA, 495 bp, Artificial Sequence
  source: /note="Description of Artificial Sequence: Synthetic polynucleotide"
gcctccctcgcgccatcagcactgtacggtgtcatcgcacaaaaacccgagcgcagtctcgtccccggtcccccggcggccccagcttacccagcactgagagccgggtcccggcgccgaagtactgaatgttttgtcgaccactgtacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacactgtacggtgtcatctgagcgggctggcaaggc

SEQ ID NO: 362 - DNA, 495 bp, Artificial Sequence
  source: /note="Description of Artificial Sequence: Synthetic polynucleotide"
gcctccctcgcgccatcaggatgatccggtgtcatccccgcaaaaaccagacccaagccgcccgcgcccgcgccccagcagcccgcgctcaccgagcaccaggagccgcgtgcctggcccgaagtactgggtctcgtcgacgatgatccggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagatgatccggtgtcatctgagcgggctggcaaggc

SEQ ID NO: 363 - DNA, 495 bp, Artificial Sequence
  source: /note="Description of Artificial Sequence: Synthetic polynucleotide"
gcctccctcgcgccatcagcgccaataggtgtcatccgccgccttccacctgaatcccgccgcccgggtggtcccgcgaaaactcacccagcacggtcagcctgctgccggccccgaaagtcaggacgttggcccgtcgaccgccaataggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacgccaataggtgtcatctgagcgggctggcaaggc

SEQ ID NO: 364 - DNA, 495 bp, Artificial Sequence
  source: /note="Description of Artificial Sequence: Synthetic polynucleotide"
gcctccctcgcgccatcagtcaagcctggtgtcatccaccctccgactccggggaccgaggggctggaaggtggggagacgcccgaatctcacctgtgaccgtgagcctggtgcccggcccgaagtactgctcgtgtcgactcaagcctggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaatcaagcctggtgtcatctgagcgggctggcaaggc

SEQ ID NO: 365 - DNA, 495 bp, Artificial Sequence
  source: /note="Description of Artificial Sequence: Synthetic polynucleotide"
gcctccctcgcgccatcagagagtgtctcgtgaagctgtggacccacttttccctgtgacggatctgcaaaagaacctgaaaaatgtcttacctacaactgtgagtctggtgccttgtccaaagaaagcttcagtgtcgacagagtgtctcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaaagagtgtctcgtgaagctgagcgggctggcaaggc

SEQ ID NO: 366 - DNA, 495 bp, Artificial Sequence
  source: /note="Description of Artificial Sequence: Synthetic polynucleotide"
gcctccctcgcgccatcaggttccgaatcgtgaagatttcccaggacagagtcctccctcatcgcacccctcctagagacccccagccttacctacaacggttaacctggtccccgaaccgaaggtgtagccatagtcgacgttccgaatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagttccgaatcgtgaagctgagcgggctggcaaggc

SEQ ID NO: 367 - DNA, 495 bp, Artificial Sequence
  source: /note="Description of Artificial Sequence: Synthetic polynucleotide"
gcctccctcgcgccatcagcgttactttcgtgaagctggattccagcccctttttgcaagttcccagctgtccagccttgacttactcacctacaacagtgagccaacttccctctccaaaatatatggtgtttcgtcgaccgttactttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacgttactttcgtgaagctgagcgggctggcaaggc

SEQ ID NO: 368 - DNA, 495 bp, Artificial Sequence
  source: /note="Description of Artificial Sequence: Synthetic polynucleotide"
gcctccctcgcgccatcagtaggagactcgtgaagctcctggaactccgaccttatgatacactatcccgaaagaagtcttttacatacccaagacagagagctgggttccactgccaaaaaacagtttttcattgtcgactaggagactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaataggagactcgtgaagctgagcgggctggcaaggc

SEQ ID NO: 369 - DNA, 495 bp, Artificial Sequence
  source: /note="Description of Artificial Sequence: Synthetic polynucleotide"
gcctccctcgcgccatcaggacactcttcgtgaagagagaactctgccttcaagggacaatggccataccaccctgattctgcaacttacctaggatggagagtcgagtcccatcaccaaaatgctggggctgatgtcgacgacactcttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagacactcttcgtgaagctgagcgggctggcaaggc

SEQ ID NO: 370 - DNA, 495 bp, Artificial Sequence
  source: /note="Description of Artificial Sequence: Synthetic polynucleotide"
gcctccctcgcgccatcagttcggaactcgtgaagatcattgcagtcaaacccaggcacccccgagtcaagagtggagcccccatacctgtcacagtgagcctggtcccgttcccaaagtggaggggtgaattatgtcgacttcggaactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaattcggaactcgtgaagctgagcgggctggcaaggc

SEQ ID NO: 371 - DNA, 495 bp, Artificial Sequence
  source: /note="Description of Artificial Sequence: Synthetic polynucleotide"
gcctccctcgcgccatcagaagtaacgtcgtgaaggggtcgtgcaggctgggctgctcaccctctctcccacctggagcccccttcttacctagcacggtgagccgtgtccctggcccgaagaactgctcattgtgtcgacaagtaacgtcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaaaagtaacgtcgtgaagctgagcgggctggcaaggc

SEQ ID NO: 372 - DNA, 495 bp, Artificial Sequence
  source: /note="Description of Artificial Sequence: Synthetic polynucleotide"
gcctccctcgcgccatcaggtctcctatcgtgaagcctctgcccatcccgccctctcggagctctccggagccccaaccgcctccttacccagtacggtcagcctagagccttctccaaaaaacagctccccggtgtcgacgtctcctatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagtctcctatcgtgaagctgagcgggctggcaaggc

SEQ ID NO: 373 - DNA, 495 bp, Artificial Sequence
  source: /note="Description of Artificial Sequence: Synthetic polynucleotide"
gcctccctcgcgccatcaggtagacactcgtgaaggcgtcccggggcgccccctccccagttccggggcttcagcgggagcccccgcttaccgagcactgtcagccgggtgcctgggccaaaatactgcgtatctgtcgacgtagacactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagtagacactcgtgaagctgagcgggctggcaaggc

SEQ ID NO: 374 - DNA, 495 bp, Artificial Sequence
  source: /note="Description of Artificial Sequence: Synthetic polynucleotide"
gcctccctcgcgccatcagcactgtactcgtgaagcgcacaaaaacccgagcgcagtctcgtccccggtcccccggcggccccagcttacccagcactgagagccgggtcccggcgccgaagtactgaatgttttgtcgaccactgtactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacactgtactcgtgaagctgagcgggctggcaaggc

SEQ ID NO: 375 - DNA, 495 bp, Artificial Sequence
  source: /note="Description of Artificial Sequence: Synthetic polynucleotide"
gcctccctcgcgccatcaggatgatcctcgtgaagccccgcaaaaaccagacccaagccgcccgcgcccgcgccccagcagcccgcgctcaccgagcaccaggagccgcgtgcctggcccgaagtactgggtctcgtcgacgatgatcctcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagatgatcctcgtgaagctgagcgggctggcaaggc

SEQ ID NO: 376 - DNA, 495 bp, Artificial Sequence
  source: /note="Description of Artificial Sequence: Synthetic polynucleotide"
gcctccctcgcgccatcagcgccaatatcgtgaagccgccgccttccacctgaatcccgccgcccgggtggtcccgcgaaaactcacccagcacggtcagcctgctgccggccccgaaagtcaggacgttggcccgtcgaccgccaatatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacgccaatatcgtgaagctgagcgggctggcaaggc

SEQ ID NO: 377 - DNA, 495 bp, Artificial Sequence
  source: /note="Description of Artificial Sequence: Synthetic polynucleotide"
gcctccctcgcgccatcagtcaagccttcgtgaagccaccctccgactccggggaccgaggggctggaaggtggggagacgcccgaatctcacctgtgaccgtgagcctggtgcccggcccgaagtactgctcgtgtcgactcaagccttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaatcaagccttcgtgaagctgagcgggctggcaaggc

SEQ ID NO: 378 - DNA, 495 bp, Artificial Sequence
  source: /note="Description of Artificial Sequence: Synthetic polynucleotide"
gcctccctcgcgccatcagagagtgtccactagctctgtggacccacttttccctgtgacggatctgcaaaagaacctgaaaaatgtcttacctacaactgtgagtctggtgccttgtccaaagaaagcttcagtgtcgacagagtgtccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaaagagtgtccactagctctgagcgggctggcaaggc

SEQ ID NO: 379 - DNA, 495 bp, Artificial Sequence
  source: /note="Description of Artificial Sequence: Synthetic polynucleotide"
gcctccctcgcgccatcaggttccgaacactagctatttcccaggacagagtcctccctcatcgcacccctcctagagacccccagccttacctacaacggttaacctggtccccgaaccgaaggtgtagccatagtcgacgttccgaacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagttccgaacactagctctgagcgggctggcaaggc

SEQ ID NO: 380 - DNA, 495 bp, Artificial Sequence
  source: /note="Description of Artificial Sequence: Synthetic polynucleotide"
gcctccctcgcgccatcagcgttacttcactagctctggattccagcccctttttgcaagttcccagctgtccagccttgacttactcacctacaacagtgagccaacttccctctccaaaatatatggtgtttcgtcgaccgttacttcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacgttacttcactagctctgagcgggctggcaaggc

SEQ ID NO: 381 - DNA, 495 bp, Artificial Sequence
  source: /note="Description of Artificial Sequence: Synthetic polynucleotide"
gcctccctcgcgccatcagtaggagaccactagctctcctggaactccgaccttatgatacactatcccgaaagaagtcttttacatacccaagacagagagctgggttccactgccaaaaaacagtttttcattgtcgactaggagaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaataggagaccactagctctgagcgggctggcaaggc

SEQ ID NO: 382 - DNA, 495 bp, Artificial Sequence
  source: /note="Description of Artificial Sequence: Synthetic polynucleotide"
gcctccctcgcgccatcaggacactctcactagctagagaactctgccttcaagggacaatggccataccaccctgattctgcaacttacctaggatggagagtcgagtcccatcaccaaaatgctggggctgatgtcgacgacactctcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagacactctcactagctctgagcgggctggcaaggc

SEQ ID NO: 383 - DNA, 495 bp, Artificial Sequence
  source: /note="Description of Artificial Sequence: Synthetic polynucleotide"
gcctccctcgcgccatcagttcggaaccactagctatcattgcagtcaaacccaggcacccccgagtcaagagtggagcccccatacctgtcacagtgagcctggtcccgttcccaaagtggaggggtgaattatgtcgacttcggaaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaattcggaaccactagctctgagcgggctggcaaggc

SEQ ID NO: 384 - DNA, 495 bp, Artificial Sequence
  source: /note="Description of Artificial Sequence: Synthetic polynucleotide"
gcctccctcgcgccatcagaagtaacgcactagctgggtcgtgcaggctgggctgctcaccctctctcccacctggagcccccttcttacctagcacggtgagccgtgtccctggcccgaagaactgctcattgtgtcgacaagtaacgcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaaaagtaacgcactagctctgagcgggctggcaaggc

SEQ ID NO: 385 - DNA, 495 bp, Artificial Sequence
  source: /note="Description of Artificial Sequence: Synthetic polynucleotide"
gcctccctcgcgccatcaggtctcctacactagctcctctgcccatcccgccctctcggagctctccggagccccaaccgcctccttacccagtacggtcagcctagagccttctccaaaaaacagctccccggtgtcgacgtctcctacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagtctcctacactagctctgagcgggctggcaaggc

SEQ ID NO: 386 - DNA, 495 bp, Artificial Sequence
  source: /note="Description of Artificial Sequence: Synthetic polynucleotide"
gcctccctcgcgccatcaggtagacaccactagctgcgtcccggggcgccccctccccagttccggggcttcagcgggagcccccgcttaccgagcactgtcagccgggtgcctgggccaaaatactgcgtatctgtcgacgtagacaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagtagacaccactagctctgagcgggctggcaaggc

SEQ ID NO: 387 - DNA, 495 bp, Artificial Sequence
  source: /note="Description of Artificial Sequence: Synthetic polynucleotide"
gcctccctcgcgccatcagcactgtaccactagctcgcacaaaaacccgagcgcagtctcgtccccggtcccccggcggccccagcttacccagcactgagagccgggtcccggcgccgaagtactgaatgttttgtcgaccactgtaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacactgtaccactagctctgagcgggctggcaaggc

SEQ ID NO: 388 - DNA, 495 bp, Artificial Sequence
  source: /note="Description of Artificial Sequence: Synthetic polynucleotide"
gcctccctcgcgccatcaggatgatcccactagctccccgcaaaaaccagacccaagccgcccgcgcccgcgccccagcagcccgcgctcaccgagcaccaggagccgcgtgcctggcccgaagtactgggtctcgtcgacgatgatcccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagatgatcccactagctctgagcgggctggcaaggc

SEQ ID NO: 389 - DNA, 495 bp, Artificial Sequence
  source: /note="Description of Artificial Sequence: Synthetic polynucleotide"
gcctccctcgcgccatcagcgccaatacactagctccgccgccttccacctgaatcccgccgcccgggtggtcccgcgaaaactcacccagcacggtcagcctgctgccggccccgaaagtcaggacgttggcccgtcgaccgccaatacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacgccaatacactagctctgagcgggctggcaaggc

SEQ ID NO: 390 - DNA, 495 bp, Artificial Sequence
  source: /note="Description of Artificial Sequence: Synthetic polynucleotide"
gcctccctcgcgccatcagtcaagcctcactagctccaccctccgactccggggaccgaggggctggaaggtggggagacgcccgaatctcacctgtgaccgtgagcctggtgcccggcccgaagtactgctcgtgtcgactcaagcctcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaatcaagcctcactagctctgagcgggctggcaaggc

SEQ ID NO: 391 - DNA, 495 bp, Artificial Sequence
  source: /note="Description of Artificial Sequence: Synthetic polynucleotide"
gcctccctcgcgccatcagagagtgtccttggttactgtggacccacttttccctgtgacggatctgcaaaagaacctgaaaaatgtcttacctacaactgtgagtctggtgccttgtccaaagaaagcttcagtgtcgacagagtgtccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaaagagtgtccttggttactgagcgggctggcaaggc

SEQ ID NO: 392 - DNA, 495 bp, Artificial Sequence
  source: /note="Description of Artificial Sequence: Synthetic polynucleotide"
gcctccctcgcgccatcaggttccgaacttggttaatttcccaggacagagtcctccctcatcgcacccctcctagagacccccagccttacctacaacggttaacctggtccccgaaccgaaggtgtagccatagtcgacgttccgaacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagttccgaacttggttactgagcgggctggcaaggc

SEQ ID NO: 393 - DNA, 495 bp, Artificial Sequence
  source: /note="Description of Artificial Sequence: Synthetic polynucleotide"
gcctccctcgcgccatcagcgttacttcttggttactggattccagcccctttttgcaagttcccagctgtccagccttgacttactcacctacaacagtgagccaacttccctctccaaaatatatggtgtttcgtcgaccgttacttcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacgttacttcttggttactgagcgggctggcaaggc

SEQ ID NO: 394 - DNA, 495 bp, Artificial Sequence
  source: /note="Description of Artificial Sequence: Synthetic polynucleotide"
gcctccctcgcgccatcagtaggagaccttggttactcctggaactccgaccttatgatacactatcccgaaagaagtcttttacatacccaagacagagagctgggttccactgccaaaaaacagtttttcattgtcgactaggagaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaataggagaccttggttactgagcgggctggcaaggc

SEQ ID NO: 395 - DNA, 495 bp, Artificial Sequence
  source: /note="Description of Artificial Sequence: Synthetic polynucleotide"
gcctccctcgcgccatcaggacactctcttggttaagagaactctgccttcaagggacaatggccataccaccctgattctgcaacttacctaggatggagagtcgagtcccatcaccaaaatgctggggctgatgtcgacgacactctcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagacactctcttggttactgagcgggctggcaaggc

SEQ ID NO: 396 - DNA, 495 bp, Artificial Sequence
  source: /note="Description of Artificial Sequence: Synthetic polynucleotide"
gcctccctcgcgccatcagttcggaaccttggttaatcattgcagtcaaacccaggcacccccgagtcaagagtggagcccccatacctgtcacagtgagcctggtcccgttcccaaagtggaggggtgaattatgtcgacttcggaaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaattcggaaccttggttactgagcgggctggcaaggc

SEQ ID NO: 397 - DNA, 495 bp, Artificial Sequence
  source: /note="Description of Artificial Sequence: Synthetic polynucleotide"
gcctccctcgcgccatcagaagtaacgcttggttagggtcgtgcaggctgggctgctcaccctctctcccacctggagcccccttcttacctagcacggtgagccgtgtccctggcccgaagaactgctcattgtgtcgacaagtaacgcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaaaagtaacgcttggttactgagcgggctggcaaggc

SEQ ID NO: 398 - DNA, 495 bp, Artificial Sequence
  source: /note="Description of Artificial Sequence: Synthetic polynucleotide"
gcctccctcgcgccatcaggtctcctacttggttacctctgcccatcccgccctctcggagctctccggagccccaaccgcctccttacccagtacggtcagcctagagccttctccaaaaaacagctccccggtgtcgacgtctcctacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagtctcctacttggttactgagcgggctggcaaggc

SEQ ID NO: 399 - DNA, 495 bp, Artificial Sequence
  source: /note="Description of Artificial Sequence: Synthetic polynucleotide"
gcctccctcgcgccatcaggtagacaccttggttagcgtcccggggcgccccctccccagttccggggcttcagcgggagcccccgcttaccgagcactgtcagccgggtgcctgggccaaaatactgcgtatctgtcgacgtagacaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagtagacaccttggttactgagcgggctggcaaggc

SEQ ID NO: 400 - DNA, 495 bp, Artificial Sequence
  source: /note="Description of Artificial Sequence: Synthetic polynucleotide"
gcctccctcgcgccatcagcactgtaccttggttacgcacaaaaacccgagcgcagtctcgtccccggtcccccggcggccccagcttacccagcactgagagccgggtcccggcgccgaagtactgaatgttttgtcgaccactgtaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacactgtaccttggttactgagcgggctggcaaggc

SEQ ID NO: 401 - DNA, 495 bp, Artificial Sequence
  source: /note="Description of Artificial Sequence: Synthetic polynucleotide"
gcctccctcgcgccatcaggatgatcccttggttaccccgcaaaaaccagacccaagccgcccgcgcccgcgccccagcagcccgcgctcaccgagcaccaggagccgcgtgcctggcccgaagtactgggtctcgtcgacgatgatcccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagatgatcccttggttactgagcgggctggcaaggc

SEQ ID NO: 402 - DNA, 495 bp, Artificial Sequence
  source: /note="Description of Artificial Sequence: Synthetic polynucleotide"
gcctccctcgcgccatcagcgccaatacttggttaccgccgccttccacctgaatcccgccgcccgggtggtcccgcgaaaactcacccagcacggtcagcctgctgccggccccgaaagtcaggacgttggcccgtcgaccgccaatacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacgccaatacttggttactgagcgggctggcaaggc

SEQ ID NO: 403 - DNA, 495 bp, Artificial Sequence
  source: /note="Description of Artificial Sequence: Synthetic polynucleotide"
gcctccctcgcgccatcagtcaagcctcttggttaccaccctccgactccggggaccgaggggctggaaggtggggagacgcccgaatctcacctgtgaccgtgagcctggtgcccggcccgaagtactgctcgtgtcgactcaagcctcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaatcaagcctcttggttactgagcgggctggcaaggc

SEQ ID NO: 404 - DNA, 495 bp, Artificial Sequence
  source: /note="Description of Artificial Sequence: Synthetic polynucleotide"
gcctccctcgcgccatcagagagtgtcacctcttgctgtggacccacttttccctgtgacggatctgcaaaagaacctgaaaaatgtcttacctacaactgtgagtctggtgccttgtccaaagaaagcttcagtgtcgacagagtgtcacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaaagagtgtcacctcttgctgagcgggctggcaaggc

SEQ ID NO: 405 - DNA, 495 bp, Artificial Sequence
  source: /note="Description of Artificial Sequence: Synthetic polynucleotide"
gcctccctcgcgccatcaggttccgaaacctcttgatttcccaggacagagtcctccctcatcgcacccctcctagagacccccagccttacctacaacggttaacctggtccccgaaccgaaggtgtagccatagtcgacgttccgaaacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagttccgaaacctcttgctgagcgggctggcaaggc

SEQ ID NO: 406 - DNA, 495 bp, Artificial Sequence
  source: /note="Description of Artificial Sequence: Synthetic polynucleotide"
gcctccctcgcgccatcagcgttacttacctcttgctggattccagcccctttttgcaagttcccagctgtccagccttgacttactcacctacaacagtgagccaacttccctctccaaaatatatggtgtttcgtcgaccgttacttacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacgttacttacctcttgctgagcgggctggcaaggc

SEQ ID NO: 407 - DNA, 495 bp, Artificial Sequence
  source: /note="Description of Artificial Sequence: Synthetic polynucleotide"
gcctccctcgcgccatcagtaggagacacctcttgctcctggaactccgaccttatgatacactatcccgaaagaagtcttttacatacccaagacagagagctgggttccactgccaaaaaacagtttttcattgtcgactaggagacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaataggagacacctcttgctgagcgggctggcaaggc

SEQ ID NO: 408 - DNA, 495 bp, Artificial Sequence
  source: /note="Description of Artificial Sequence: Synthetic polynucleotide"
gcctccctcgcgccatcaggacactctacctcttgagagaactctgccttcaagggacaatggccataccaccctgattctgcaacttacctaggatggagagtcgagtcccatcaccaaaatgctggggctgatgtcgacgacactctacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagacactctacctcttgctgagcgggctggcaaggc

SEQ ID NO: 409 - DNA, 495 bp, Artificial Sequence
  source: /note="Description of Artificial Sequence: Synthetic polynucleotide"
gcctccctcgcgccatcagttcggaacacctcttgatcattgcagtcaaacccaggcacccccgagtcaagagtggagcccccatacctgtcacagtgagcctggtcccgttcccaaagtggaggggtgaattatgtcgacttcggaacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaattcggaacacctcttgctgagcgggctggcaaggc

SEQ ID NO: 410 - DNA, 495 bp, Artificial Sequence
  source: /note="Description of Artificial Sequence: Synthetic polynucleotide"
gcctccctcgcgccatcagaagtaacgacctcttggggtcgtgcaggctgggctgctcaccctctctcccacctggagcccccttcttacctagcacggtgagccgtgtccctggcccgaagaactgctcattgtgtcgacaagtaacgacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaaaagtaacgacctcttgctgagcgggctggcaaggc

SEQ ID NO: 411 - DNA, 495 bp, Artificial Sequence
  source: /note="Description of Artificial Sequence: Synthetic polynucleotide"
gcctccctcgcgccatcaggtctcctaacctcttgcctctgcccatcccgccctctcggagctctccggagccccaaccgcctccttacccagtacggtcagcctagagccttctccaaaaaacagctccccggtgtcgacgtctcctaacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagtctcctaacctcttgctgagcgggctggcaaggc

SEQ ID NO: 412 - DNA, 495 bp, Artificial Sequence
  source: /note="Description of Artificial Sequence: Synthetic polynucleotide"
gcctccctcgcgccatcaggtagacacacctcttggcgtcccggggcgccccctccccagttccggggcttcagcgggagcccccgcttaccgagcactgtcagccgggtgcctgggccaaaatactgcgtatctgtcgacgtagacacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagtagacacacctcttgctgagcgggctggcaaggc

SEQ ID NO: 413 - DNA, 495 bp, Artificial Sequence
  source: /note="Description of Artificial Sequence: Synthetic polynucleotide"
gcctccctcgcgccatcagcactgtacacctcttgcgcacaaaaacccgagcgcagtctcgtccccggtcccccggcggccccagcttacccagcactgagagccgggtcccggcgccgaagtactgaatgttttgtcgaccactgtacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacactgtacacctcttgctgagcgggctggcaaggc

SEQ ID NO: 414 - DNA, 495 bp, Artificial Sequence
  source: /note="Description of Artificial Sequence: Synthetic polynucleotide"
gcctccctcgcgccatcaggatgatccacctcttgccccgcaaaaaccagacccaagccgcccgcgcccgcgccccagcagcccgcgctcaccgagcaccaggagccgcgtgcctggcccgaagtactgggtctcgtcgacgatgatccacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagatgatccacctcttgctgagcgggctggcaaggc

SEQ ID NO: 415 - DNA, 495 bp, Artificial Sequence
  source: /note="Description of Artificial Sequence: Synthetic polynucleotide"
gcctccctcgcgccatcagcgccaataacctcttgccgccgccttccacctgaatcccgccgcccgggtggtcccgcgaaaactcacccagcacggtcagcctgctgccggccccgaaagtcaggacgttggcccgtcgaccgccaataacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacgccaataacctcttgctgagcgggctggcaaggc

SEQ ID NO: 416 - DNA, 495 bp, Artificial Sequence
  source: /note="Description of Artificial Sequence: Synthetic polynucleotide"
gcctccctcgcgccatcagtcaagcctacctcttgccaccctccgactccggggaccgaggggctggaaggtggggagacgcccgaatctcacctgtgaccgtgagcctggtgcccggcccgaagtactgctcgtgtcgactcaagcctacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaatcaagcctacctcttgctgagcgggctggcaaggc

SEQ ID NO: 417 - DNA, 495 bp, Artificial Sequence
  source: /note="Description of Artificial Sequence: Synthetic polynucleotide"
gcctccctcgcgccatcagagagtgtcctgattctctgtggacccacttttccctgtgacggatctgcaaaagaacctgaaaaatgtcttacctacaactgtgagtctggtgccttgtccaaagaaagcttcagtgtcgacagagtgtcctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagagagtgtcctgattctctgagcgggctggcaaggc

SEQ ID NO: 418 - DNA, 495 bp, Artificial Sequence
  source: /note="Description of Artificial Sequence: Synthetic polynucleotide"
gcctccctcgcgccatcaggttccgaactgattctatttcccaggacagagtcctccctcatcgcacccctcctagagacccccagccttacctacaacggttaacctggtccccgaaccgaaggtgtagccatagtcgacgttccgaactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggttccgaactgattctctgagcgggctggcaaggc

SEQ ID NO: 419 - DNA, 495 bp, Artificial Sequence
  source: /note="Description of Artificial Sequence: Synthetic polynucleotide"
gcctccctcgcgccatcagcgttacttctgattctctggattccagcccctttttgcaagttcccagctgtccagccttgacttactcacctacaacagtgagccaacttccctctccaaaatatatggtgtttcgtcgaccgttacttctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcgttacttctgattctctgagcgggctggcaaggc

SEQ ID NO: 420 - DNA, 495 bp, Artificial Sequence
  source: /note="Description of Artificial Sequence: Synthetic polynucleotide"
gcctccctcgcgccatcagtaggagacctgattctctcctggaactccgaccttatgatacactatcccgaaagaagtcttttacatacccaagacagagagctgggttccactgccaaaaaacagtttttcattgtcgactaggagacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagtaggagacctgattctctgagcgggctggcaaggc

SEQ ID NO: 421 - DNA, 495 bp, Artificial Sequence
  source: /note="Description of Artificial Sequence: Synthetic polynucleotide"
gcctccctcgcgccatcaggacactctctgattctagagaactctgccttcaagggacaatggccataccaccctgattctgcaacttacctaggatggagagtcgagtcccatcaccaaaatgctggggctgatgtcgacgacactctctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggacactctctgattctctgagcgggctggcaaggc

SEQ ID NO: 422 - DNA, 495 bp, Artificial Sequence
  source: /note="Description of Artificial Sequence: Synthetic polynucleotide"
gcctccctcgcgccatcagttcggaacctgattctatcattgcagtcaaacccaggcacccccgagtcaagagtggagcccccatacctgtcacagtgagcctggtcccgttcccaaagtggaggggtgaattatgtcgacttcggaacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagttcggaacctgattctctgagcgggctggcaaggc

SEQ ID NO: 423 - DNA, 495 bp, Artificial Sequence
  source: /note="Description of Artificial Sequence: Synthetic polynucleotide"
gcctccctcgcgccatcagaagtaacgctgattctgggtcgtgcaggctgggctgctcaccctctctcccacctggagcccccttcttacctagcacggtgagccgtgtccctggcccgaagaactgctcattgtgtcgacaagtaacgctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagaagtaacgctgattctctgagcgggctggcaaggc

SEQ ID NO: 424 - DNA, 495 bp, Artificial Sequence
  source: /note="Description of Artificial Sequence: Synthetic polynucleotide"
gcctccctcgcgccatcaggtctcctactgattctcctctgcccatcccgccctctcggagctctccggagccccaaccgcctccttacccagtacggtcagcctagagccttctccaaaaaacagctccccggtgtcgacgtctcctactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggtctcctactgattctctgagcgggctggcaaggc

SEQ ID NO: 425 - DNA, 495 bp, Artificial Sequence
  source: /note="Description of Artificial Sequence: Synthetic polynucleotide"
gcctccctcgcgccatcaggtagacacctgattctgcgtcccggggcgccccctccccagttccggggcttcagcgggagcccccgcttaccgagcactgtcagccgggtgcctgggccaaaatactgcgtatctgtcgacgtagacacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggtagacacctgattctctgagcgggctggcaaggc

SEQ ID NO: 426 - DNA, 495 bp, Artificial Sequence
  source: /note="Description of Artificial Sequence: Synthetic polynucleotide"
gcctccctcgcgccatcagcactgtacctgattctcgcacaaaaacccgagcgcagtctcgtccccggtcccccggcggccccagcttacccagcactgagagccgggtcccggcgccgaagtactgaatgttttgtcgaccactgtacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcactgtacctgattctctgagcgggctggcaaggc

SEQ ID NO: 427 - DNA, 495 bp, Artificial Sequence
  source: /note="Description of Artificial Sequence: Synthetic polynucleotide"
gcctccctcgcgccatcaggatgatccctgattctccccgcaaaaaccagacccaagccgcccgcgcccgcgccccagcagcccgcgctcaccgagcaccaggagccgcgtgcctggcccgaagtactgggtctcgtcgacgatgatccctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggatgatccctgattctctgagcgggctggcaaggc

SEQ ID NO: 428 - DNA, 495 bp, Artificial Sequence
  source: /note="Description of Artificial Sequence: Synthetic polynucleotide"
gcctccctcgcgccatcagcgccaatactgattctccgccgccttccacctgaatcccgccgcccgggtggtcccgcgaaaactcacccagcacggtcagcctgctgccggccccgaaagtcaggacgttggcccgtcgaccgccaatactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcgccaatactgattctctgagcgggctggcaaggc

SEQ ID NO: 429 - DNA, 495 bp, Artificial Sequence
  source: /note="Description of Artificial Sequence: Synthetic polynucleotide"
gcctccctcgcgccatcagtcaagcctctgattctccaccctccgactccggggaccgaggggctggaaggtggggagacgcccgaatctcacctgtgaccgtgagcctggtgcccggcccgaagtactgctcgtgtcgactcaagcctctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagtcaagcctctgattctctgagcgggctggcaaggc

SEQ ID NO: 430 - DNA, 495 bp, Artificial Sequence
  source: /note="Description of Artificial Sequence: Synthetic polynucleotide"
gcctccctcgcgccatcagagagtgtcggtcaactctgtggacccacttttccctgtgacggatctgcaaaagaacctgaaaaatgtcttacctacaactgtgagtctggtgccttgtccaaagaaagcttcagtgtcgacagagtgtcggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagagagtgtcggtcaactctgagcgggctggcaaggc

SEQ ID NO: 431 - DNA, 495 bp, Artificial Sequence
  source: /note="Description of Artificial Sequence: Synthetic polynucleotide"
gcctccctcgcgccatcaggttccgaaggtcaactatttcccaggacagagtcctccctcatcgcacccctcctagagacccccagccttacctacaacggttaacctggtccccgaaccgaaggtgtagccatagtcgacgttccgaaggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggttccgaaggtcaactctgagcgggctggcaaggc

SEQ ID NO: 432 - DNA, 495 bp, Artificial Sequence
  source: /note="Description of Artificial Sequence: Synthetic polynucleotide"
gcctccctcgcgccatcagcgttacttggtcaactctggattccagcccctttttgcaagttcccagctgtccagccttgacttactcacctacaacagtgagccaacttccctctccaaaatatatggtgtttcgtcgaccgttacttggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcgttacttggtcaactctgagcgggctggcaaggc

SEQ ID NO: 433 - DNA, 495 bp, Artificial Sequence
  source: /note="Description of Artificial Sequence: Synthetic polynucleotide"
gcctccctcgcgccatcagtaggagacggtcaactctcctggaactccgaccttatgatacactatcccgaaagaagtcttttacatacccaagacagagagctgggttccactgccaaaaaacagtttttcattgtcgactaggagacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagtaggagacggtcaactctgagcgggctggcaaggc

SEQ ID NO: 434 - DNA, 495 bp, Artificial Sequence
  source: /note="Description of Artificial Sequence: Synthetic polynucleotide"
gcctccctcgcgccatcaggacactctggtcaactagagaactctgccttcaagggacaatggccataccaccctgattctgcaacttacctaggatggagagtcgagtcccatcaccaaaatgctggggctgatgtcgacgacactctggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggacactctggtcaactctgagcgggctggcaaggc

SEQ ID NO: 435 - DNA, 495 bp, Artificial Sequence
  source: /note="Description of Artificial Sequence: Synthetic polynucleotide"
gcctccctcgcgccatcagttcggaacggtcaactatcattgcagtcaaacccaggcacccccgagtcaagagtggagcccccatacctgtcacagtgagcctggtcccgttcccaaagtggaggggtgaattatgtcgacttcggaacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagttcggaacggtcaactctgagcgggctggcaaggc

SEQ ID NO: 436 - DNA, 495 bp, Artificial Sequence
  source: /note="Description of Artificial Sequence: Synthetic polynucleotide"
gcctccctcgcgccatcagaagtaacgggtcaactgggtcgtgcaggctgggctgctcaccctctctcccacctggagcccccttcttacctagcacggtgagccgtgtccctggcccgaagaactgctcattgtgtcgacaagtaacgggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagaagtaacgggtcaactctgagcgggctggcaaggc

SEQ ID NO: 437 - DNA, 495 bp, Artificial Sequence
  source: /note="Description of Artificial Sequence: Synthetic polynucleotide"
gcctccctcgcgccatcaggtctcctaggtcaactcctctgcccatcccgccctctcggagctctccggagccccaaccgcctccttacccagtacggtcagcctagagccttctccaaaaaacagctccccggtgtcgacgtctcctaggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggtctcctaggtcaactctgagcgggctggcaaggc

SEQ ID NO: 438 - DNA, 495 bp, Artificial Sequence
  source: /note="Description of Artificial Sequence: Synthetic polynucleotide"
gcctccctcgcgccatcaggtagacacggtcaactgcgtcccggggcgccccctccccagttccggggcttcagcgggagcccccgcttaccgagcactgtcagccgggtgcctgggccaaaatactgcgtatctgtcgacgtagacacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggtagacacggtcaactctgagcgggctggcaaggc

SEQ ID NO: 439 - DNA, 495 bp, Artificial Sequence
  source: /note="Description of Artificial Sequence: Synthetic polynucleotide"
gcctccctcgcgccatcagcactgtacggtcaactcgcacaaaaacccgagcgcagtctcgtccccggtcccccggcggccccagcttacccagcactgagagccgggtcccggcgccgaagtactgaatgttttgtcgaccactgtacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcactgtacggtcaactctgagcgggctggcaaggc

SEQ ID NO: 440 - DNA, 495 bp, Artificial Sequence
  source: /note="Description of Artificial Sequence: Synthetic polynucleotide"
gcctccctcgcgccatcaggatgatccggtcaactccccgcaaaaaccagacccaagccgcccgcgcccgcgccccagcagcccgcgctcaccgagcaccaggagccgcgtgcctggcccgaagtactgggtctcgtcgacgatgatccggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggatgatccggtcaactctgagcgggctggcaaggc

SEQ ID NO: 441 - DNA, 495 bp, Artificial Sequence
  source: /note="Description of Artificial Sequence: Synthetic polynucleotide"
gcctccctcgcgccatcagcgccaataggtcaactccgccgccttccacctgaatcccgccgcccgggtggtcccgcgaaaactcacccagcacggtcagcctgctgccggccccgaaagtcaggacgttggcccgtcgaccgccaataggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcgccaataggtcaactctgagcgggctggcaaggc

SEQ ID NO: 442 - DNA, 495 bp, Artificial Sequence
  source: /note="Description of Artificial Sequence: Synthetic polynucleotide"
gcctccctcgcgccatcagtcaagcctggtcaactccaccctccgactccggggaccgaggggctggaaggtggggagacgcccgaatctcacctgtgaccgtgagcctggtgcccggcccgaagtactgctcgtgtcgactcaagcctggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagtcaagcctggtcaactctgagcgggctggcaaggc

SEQ ID NO: 443 - DNA, 495 bp, Artificial Sequence
  source: /note="Description of Artificial Sequence: Synthetic polynucleotide"
gcctccctcgcgccatcagagagtgtctacgtacgctgtggacccacttttccctgtgacggatctgcaaaagaacctgaaaaatgtcttacctacaactgtgagtctggtgccttgtccaaagaaagcttcagtgtcgacagagtgtctacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaaagagtgtctacgtacgctgagcgggctggcaaggc

SEQ ID NO: 444 - DNA, 495 bp, Artificial Sequence
  source: /note="Description of Artificial Sequence: Synthetic polynucleotide"
gcctccctcgcgccatcaggttccgaatacgtacgatttcccaggacagagtcctccctcatcgcacccctcctagagacccccagccttacctacaacggttaacctggtccccgaaccgaaggtgtagccatagtcgacgttccgaatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagttccgaatacgtacgctgagcgggctggcaaggc

SEQ ID NO: 445 - DNA, 495 bp, Artificial Sequence
  source: /note="Description of Artificial Sequence: Synthetic polynucleotide"
gcctccctcgcgccatcagcgttactttacgtacgctggattccagcccctttttgcaagttcccagctgtccagccttgacttactcacctacaacagtgagccaacttccctctccaaaatatatggtgtttcgtcgaccgttactttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacgttactttacgtacgctgagcgggctggcaaggc

SEQ ID NO: 446 - DNA, 495 bp, Artificial Sequence
  source: /note="Description of Artificial Sequence: Synthetic polynucleotide"
gcctccctcgcgccatcagtaggagactacgtacgctcctggaactccgaccttatgatacactatcccgaaagaagtcttttacatacccaagacagagagctgggttccactgccaaaaaacagtttttcattgtcgactaggagactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaataggagactacgtacgctgagcgggctggcaaggc

SEQ ID NO: 447 - DNA, 495 bp, Artificial Sequence
  source: /note="Description of Artificial Sequence: Synthetic polynucleotide"
gcctccctcgcgccatcaggacactcttacgtacgagagaactctgccttcaagggacaatggccataccaccctgattctgcaacttacctaggatggagagtcgagtcccatcaccaaaatgctggggctgatgtcgacgacactcttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagacactcttacgtacgctgagcgggctggcaaggc

SEQ ID NO: 448 - DNA, 495 bp, Artificial Sequence
  source: /note="Description of Artificial Sequence: Synthetic polynucleotide"
gcctccctcgcgccatcagttcggaactacgtacgatcattgcagtcaaacccaggcacccccgagtcaagagtggagcccccatacctgtcacagtgagcctggtcccgttcccaaagtggaggggtgaattatgtcgacttcggaactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaattcggaactacgtacgctgagcgggctggcaaggc

SEQ ID NO: 449 - DNA, 495 bp, Artificial Sequence
  source: /note="Description of Artificial Sequence: Synthetic polynucleotide"
gcctccctcgcgccatcagaagtaacgtacgtacggggtcgtgcaggctgggctgctcaccctctctcccacctggagcccccttcttacctagcacggtgagccgtgtccctggcccgaagaactgctcattgtgtcgacaagtaacgtacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaaaagtaacgtacgtacgctgagcgggctggcaaggc

SEQ ID NO: 450 - DNA, 495 bp, Artificial Sequence
  source: /note="Description of Artificial Sequence: Synthetic polynucleotide"
gcctccctcgcgccatcaggtctcctatacgtacgcctctgcccatcccgccctctcggagctctccggagccccaaccgcctccttacccagtacggtcagcctagagccttctccaaaaaacagctccccggtgtcgacgtctcctatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagtctcctatacgtacgctgagcgggctggcaaggc

SEQ ID NO: 451 - DNA, 495 bp, Artificial Sequence
  source: /note="Description of Artificial Sequence: Synthetic polynucleotide"
gcctccctcgcgccatcaggtagacactacgtacggcgtcccggggcgccccctccccagttccggggcttcagcgggagcccccgcttaccgagcactgtcagccgggtgcctgggccaaaatactgcgtatctgtcgacgtagacactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagtagacactacgtacgctgagcgggctggcaaggc

SEQ ID NO: 452 - DNA, 495 bp, Artificial Sequence
  source: /note="Description of Artificial Sequence: Synthetic polynucleotide"
gcctccctcgcgccatcagcactgtactacgtacgcgcacaaaaacccgagcgcagtctcgtccccggtcccccggcggccccagcttacccagcactgagagccgggtcccggcgccgaagtactgaatgttttgtcgaccactgtactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacactgtactacgtacgctgagcgggctggcaaggc

SEQ ID NO: 453 - DNA, 495 bp, Artificial Sequence
  source: /note="Description of Artificial Sequence: Synthetic polynucleotide"
gcctccctcgcgccatcaggatgatcctacgtacgccccgcaaaaaccagacccaagccgcccgcgcccgcgccccagcagcccgcgctcaccgagcaccaggagccgcgtgcctggcccgaagtactgggtctcgtcgacgatgatcctacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagatgatcctacgtacgctgagcgggctggcaaggc

SEQ ID NO: 454 - DNA, 495 bp, Artificial Sequence
  source: /note="Description of Artificial Sequence: Synthetic polynucleotide"
gcctccctcgcgccatcagcgccaatatacgtacgccgccgccttccacctgaatcccgccgcccgggtggtcccgcgaaaactcacccagcacggtcagcctgctgccggccccgaaagtcaggacgttggcccgtcgaccgccaatatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacgccaatatacgtacgctgagcgggctggcaaggc

SEQ ID NO: 455 - DNA, 495 bp, Artificial Sequence
  source: /note="Description of Artificial Sequence: Synthetic polynucleotide"
gcctccctcgcgccatcagtcaagccttacgtacgccaccctccgactccggggaccgaggggctggaaggtggggagacgcccgaatctcacctgtgaccgtgagcctggtgcccggcccgaagtactgctcgtgtcgactcaagccttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaatcaagccttacgtacgctgagcgggctggcaaggc

SEQ ID NO: 456 - DNA, 495 bp, Artificial Sequence
  source: /note="Description of Artificial Sequence: Synthetic polynucleotide"
gcctccctcgcgccatcagagagtgtcagtaccgactgtggacccacttttccctgtgacggatctgcaaaagaacctgaaaaatgtcttacctacaactgtgagtctggtgccttgtccaaagaaagcttcagtgtcgacagagtgtcagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagaagagtgtcagtaccgactgagcgggctggcaaggc

SEQ ID NO: 457 - DNA, 495 bp, Artificial Sequence
  source: /note="Description of Artificial Sequence: Synthetic polynucleotide"
gcctccctcgcgccatcaggttccgaaagtaccgaatttcccaggacagagtcctccctcatcgcacccctcctagagacccccagccttacctacaacggttaacctggtccccgaaccgaaggtgtagccatagtcgacgttccgaaagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagttccgaaagtaccgactgagcgggctggcaaggc

SEQ ID NO: 458 - DNA, 495 bp, Artificial Sequence
  source: /note="Description of Artificial Sequence: Synthetic polynucleotide"
gcctccctcgcgccatcagcgttacttagtaccgactggattccagcccctttttgcaagttcccagctgtccagccttgacttactcacctacaacagtgagccaacttccctctccaaaatatatggtgtttcgtcgaccgttacttagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacgttacttagtaccgactgagcgggctggcaaggc

SEQ ID NO: 459 - DNA, 495 bp, Artificial Sequence
  source: /note="Description of Artificial Sequence: Synthetic polynucleotide"
gcctccctcgcgccatcagtaggagacagtaccgactcctggaactccgaccttatgatacactatcccgaaagaagtcttttacatacccaagacagagagctgggttccactgccaaaaaacagtttttcattgtcgactaggagacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagataggagacagtaccgactgagcgggctggcaaggc

SEQ ID NO: 460 - DNA, 495 bp, Artificial Sequence
  source: /note="Description of Artificial Sequence: Synthetic polynucleotide"
gcctccctcgcgccatcaggacactctagtaccgaagagaactctgccttcaagggacaatggccataccaccctgattctgcaacttacctaggatggagagtcgagtcccatcaccaaaatgctggggctgatgtcgacgacactctagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagacactctagtaccgactgagcgggctggcaaggc

SEQ ID NO: 461 - DNA, 495 bp, Artificial Sequence
  source: /note="Description of Artificial Sequence: Synthetic polynucleotide"
gcctccctcgcgccatcagttcggaacagtaccgaatcattgcagtcaaacccaggcacccccgagtcaagagtggagcccccatacctgtcacagtgagcctggtcccgttcccaaagtggaggggtgaattatgtcgacttcggaacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagattcggaacagtaccgactgagcgggctggcaaggc

SEQ ID NO: 462 - DNA, 495 bp, Artificial Sequence
  source: /note="Description of Artificial Sequence: Synthetic polynucleotide"
gcctccctcgcgccatcagaagtaacgagtaccgagggtcgtgcaggctgggctgctcaccctctctcccacctggagcccccttcttacctagcacggtgagccgtgtccctggcccgaagaactgctcattgtgtcgacaagtaacgagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagaaagtaacgagtaccgactgagcgggctggcaaggc

SEQ ID NO: 463 - DNA, 495 bp, Artificial Sequence
  source: /note="Description of Artificial Sequence: Synthetic polynucleotide"
gcctccctcgcgccatcaggtctcctaagtaccgacctctgcccatcccgccctctcggagctctccggagccccaaccgcctccttacccagtacggtcagcctagagccttctccaaaaaacagctccccggtgtcgacgtctcctaagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagtctcctaagtaccgactgagcgggctggcaaggc

SEQ ID NO: 464 - DNA, 495 bp, Artificial Sequence
  source: /note="Description of Artificial Sequence: Synthetic polynucleotide"
gcctccctcgcgccatcaggtagacacagtaccgagcgtcccggggcgccccctccccagttccggggcttcagcgggagcccccgcttaccgagcactgtcagccgggtgcctgggccaaaatactgcgtatctgtcgacgtagacacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagtagacacagtaccgactgagcgggctggcaaggc

SEQ ID NO: 465 - DNA, 495 bp, Artificial Sequence
  source: /note="Description of Artificial Sequence: Synthetic polynucleotide"
gcctccctcgcgccatcagcactgtacagtaccgacgcacaaaaacccgagcgcagtctcgtccccggtcccccggcggccccagcttacccagcactgagagccgggtcccggcgccgaagtactgaatgttttgtcgaccactgtacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacactgtacagtaccgactgagcgggctggcaaggc

SEQ ID NO: 466 - DNA, 495 bp, Artificial Sequence
  source: /note="Description of Artificial Sequence: Synthetic polynucleotide"
gcctccctcgcgccatcaggatgatccagtaccgaccccgcaaaaaccagacccaagccgcccgcgcccgcgccccagcagcccgcgctcaccgagcaccaggagccgcgtgcctggcccgaagtactgggtctcgtcgacgatgatccagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagatgatccagtaccgactgagcgggctggcaaggc

SEQ ID NO: 467 - DNA, 495 bp, Artificial Sequence
  source: /note="Description of Artificial Sequence: Synthetic polynucleotide"
gcctccctcgcgccatcagcgccaataagtaccgaccgccgccttccacctgaatcccgccgcccgggtggtcccgcgaaaactcacccagcacggtcagcctgctgccggccccgaaagtcaggacgttggcccgtcgaccgccaataagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacgccaataagtaccgactgagcgggctggcaaggc

SEQ ID NO: 468 - DNA, 495 bp, Artificial Sequence
  source: /note="Description of Artificial Sequence: Synthetic polynucleotide"
gcctccctcgcgccatcagtcaagcctagtaccgaccaccctccgactccggggaccgaggggctggaaggtggggagacgcccgaatctcacctgtgaccgtgagcctggtgcccggcccgaagtactgctcgtgtcgactcaagcctagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagatcaagcctagtaccgactgagcgggctggcaaggc

SEQ ID NO: 469 - DNA, 495 bp, Artificial Sequence
  source: /note="Description of Artificial Sequence: Synthetic polynucleotide"
gcctccctcgcgccatcagagagtgtcatccatggctgtggacccacttttccctgtgacggatctgcaaaagaacctgaaaaatgtcttacctacaactgtgagtctggtgccttgtccaaagaaagcttcagtgtcgacagagtgtcatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagagagtgtcatccatggctgagcgggctggcaaggc

SEQ ID NO: 470 - DNA, 495 bp, Artificial Sequence
  source: /note="Description of Artificial Sequence: Synthetic polynucleotide"
gcctccctcgcgccatcaggttccgaaatccatggatttcccaggacagagtcctccctcatcgcacccctcctagagacccccagccttacctacaacggttaacctggtccccgaaccgaaggtgtagccatagtcgacgttccgaaatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggttccgaaatccatggctgagcgggctggcaaggc

SEQ ID NO: 471 - DNA, 495 bp, Artificial Sequence
  source: /note="Description of Artificial Sequence: Synthetic polynucleotide"
gcctccctcgcgccatcagcgttacttatccatggctggattccagcccctttttgcaagttcccagctgtccagccttgacttactcacctacaacagtgagccaacttccctctccaaaatatatggtgtttcgtcgaccgttacttatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcgttacttatccatggctgagcgggctggcaaggc

SEQ ID NO: 472 - DNA, 495 bp, Artificial Sequence
  source: /note="Description of Artificial Sequence: Synthetic polynucleotide"
gcctccctcgcgccatcagtaggagacatccatggctcctggaactccgaccttatgatacactatcccgaaagaagtcttttacatacccaagacagagagctgggttccactgccaaaaaacagtttttcattgtcgactaggagacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagtaggagacatccatggctgagcgggctggcaaggc

SEQ ID NO: 473 - DNA, 495 bp, Artificial Sequence
  source: /note="Description of Artificial Sequence: Synthetic polynucleotide"
gcctccctcgcgccatcaggacactctatccatggagagaactctgccttcaagggacaatggccataccaccctgattctgcaacttacctaggatggagagtcgagtcccatcaccaaaatgctggggctgatgtcgacgacactctatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggacactctatccatggctgagcgggctggcaaggc

SEQ ID NO: 474 - DNA, 495 bp, Artificial Sequence
  source: /note="Description of Artificial Sequence: Synthetic polynucleotide"
gcctccctcgcgccatcagttcggaacatccatggatcattgcagtcaaacccaggcacccccgagtcaagagtggagcccccatacctgtcacagtgagcctggtcccgttcccaaagtggaggggtgaattatgtcgacttcggaacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagttcggaacatccatggctgagcgggctggcaaggc

SEQ ID NO: 475 - DNA, 495 bp, Artificial Sequence
  source: /note="Description of Artificial Sequence: Synthetic polynucleotide"
gcctccctcgcgccatcagaagtaacgatccatgggggtcgtgcaggctgggctgctcaccctctctcccacctggagcccccttcttacctagcacggtgagccgtgtccctggcccgaagaactgctcattgtgtcgacaagtaacgatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagaagtaacgatccatggctgagcgggctggcaaggc

SEQ ID NO: 476 - DNA, 495 bp, Artificial Sequence
  source: /note="Description of Artificial Sequence: Synthetic polynucleotide"
gcctccctcgcgccatcaggtctcctaatccatggcctctgcccatcccgccctctcggagctctccggagccccaaccgcctccttacccagtacggtcagcctagagccttctccaaaaaacagctccccggtgtcgacgtctcctaatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggtctcctaatccatggctgagcgggctggcaaggc

SEQ ID NO: 477 - DNA, 495 bp, Artificial Sequence
  source: /note="Description of Artificial Sequence: Synthetic polynucleotide"
gcctccctcgcgccatcaggtagacacatccatgggcgtcccggggcgccccctccccagttccggggcttcagcgggagcccccgcttaccgagcactgtcagccgggtgcctgggccaaaatactgcgtatctgtcgacgtagacacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggtagacacatccatggctgagcgggctggcaaggc

SEQ ID NO: 478 - DNA, 495 bp, Artificial Sequence
  source: /note="Description of Artificial Sequence: Synthetic polynucleotide"
gcctccctcgcgccatcagcactgtacatccatggcgcacaaaaacccgagcgcagtctcgtccccggtcccccggcggccccagcttacccagcactgagagccgggtcccggcgccgaagtactgaatgttttgtcgaccactgtacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcactgtacatccatggctgagcgggctggcaaggc

SEQ ID NO: 479 - DNA, 495 bp, Artificial Sequence
  source: /note="Description of Artificial Sequence: Synthetic polynucleotide"
gcctccctcgcgccatcaggatgatccatccatggccccgcaaaaaccagacccaagccgcccgcgcccgcgccccagcagcccgcgctcaccgagcaccaggagccgcgtgcctggcccgaagtactgggtctcgtcgacgatgatccatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggatgatccatccatggctgagcgggctggcaaggc

SEQ ID NO: 480 - DNA, 495 bp, Artificial Sequence
  source: /note="Description of Artificial Sequence: Synthetic polynucleotide"
gcctccctcgcgccatcagcgccaataatccatggccgccgccttccacctgaatcccgccgcccgggtggtcccgcgaaaactcacccagcacggtcagcctgctgccggccccgaaagtcaggacgttggcccgtcgaccgccaataatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcgccaataatccatggctgagcgggctggcaaggc

SEQ ID NO: 481 - DNA, 495 bp, Artificial Sequence
  source: /note="Description of Artificial Sequence: Synthetic polynucleotide"
gcctccctcgcgccatcagtcaagcctatccatggccaccctccgactccggggaccgaggggctggaaggtggggagacgcccgaatctcacctgtgaccgtgagcctggtgcccggcccgaagtactgctcgtgtcgactcaagcctatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagtcaagcctatccatggctgagcgggctggcaaggc

SEQ ID NO: 482 - DNA, 495 bp, Artificial Sequence
  source: /note="Description of Artificial Sequence: Synthetic polynucleotide"
gcctccctcgcgccatcagagagtgtcgtagcagtctgtggacccacttttccctgtgacggatctgcaaaagaacctgaaaaatgtcttacctacaactgtgagtctggtgccttgtccaaagaaagcttcagtgtcgacagagtgtcgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagagagtgtcgtagcagtctgagcgggctggcaaggc

SEQ ID NO: 483 - DNA, 495 bp, Artificial Sequence
  source: /note="Description of Artificial Sequence: Synthetic polynucleotide"
gcctccctcgcgccatcaggttccgaagtagcagtatttcccaggacagagtcctccctcatcgcacccctcctagagacccccagccttacctacaacggttaacctggtccccgaaccgaaggtgtagccatagtcgacgttccgaagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggttccgaagtagcagtctgagcgggctggcaaggc

SEQ ID NO: 484 - DNA, 495 bp, Artificial Sequence
  source: /note="Description of Artificial Sequence: Synthetic polynucleotide"
gcctccctcgcgccatcagcgttacttgtagcagtctggattccagcccctttttgcaagttcccagctgtccagccttgacttactcacctacaacagtgagccaacttccctctccaaaatatatggtgtttcgtcgaccgttacttgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcgttacttgtagcagtctgagcgggctggcaaggc

SEQ ID NO: 485 - DNA, 495 bp, Artificial Sequence
  source: /note="Description of Artificial Sequence: Synthetic polynucleotide"
gcctccctcgcgccatcagtaggagacgtagcagtctcctggaactccgaccttatgatacactatcccgaaagaagtcttttacatacccaagacagagagctgggttccactgccaaaaaacagtttttcattgtcgactaggagacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagtaggagacgtagcagtctgagcgggctggcaaggc

SEQ ID NO: 486 - DNA, 495 bp, Artificial Sequence
  source: /note="Description of Artificial Sequence: Synthetic polynucleotide"
gcctccctcgcgccatcaggacactctgtagcagtagagaactctgccttcaagggacaatggccataccaccctgattctgcaacttacctaggatggagagtcgagtcccatcaccaaaatgctggggctgatgtcgacgacactctgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggacactctgtagcagtctgagcgggctggcaaggc

SEQ ID NO: 487 - DNA, 495 bp, Artificial Sequence
  source: /note="Description of Artificial Sequence: Synthetic polynucleotide"
gcctccctcgcgccatcagttcggaacgtagcagtatcattgcagtcaaacccaggcacccccgagtcaagagtggagcccccatacctgtcacagtgagcctggtcccgttcccaaagtggaggggtgaattatgtcgacttcggaacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagttcggaacgtagcagtctgagcgggctggcaaggc

SEQ ID NO: 488 - DNA, 495 bp, Artificial Sequence
  source: /note="Description of Artificial Sequence: Synthetic polynucleotide"
gcctccctcgcgccatcagaagtaacggtagcagtgggtcgtgcaggctgggctgctcaccctctctcccacctggagcccccttcttacctagcacggtgagccgtgtccctggcccgaagaactgctcattgtgtcgacaagtaacggtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagaagtaacggtagcagtctgagcgggctggcaaggc

SEQ ID NO: 489 - DNA, 495 bp, Artificial Sequence
  source: /note="Description of Artificial Sequence: Synthetic polynucleotide"
gcctccctcgcgccatcaggtctcctagtagcagtcctctgcccatcccgccctctcggagctctccggagccccaaccgcctccttacccagtacggtcagcctagagccttctccaaaaaacagctccccggtgtcgacgtctcctagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggtctcctagtagcagtctgagcgggctggcaaggc

SEQ ID NO: 490 - DNA, 495 bp, Artificial Sequence
  source: /note="Description of Artificial Sequence: Synthetic polynucleotide"
gcctccctcgcgccatcaggtagacacgtagcagtgcgtcccggggcgccccctccccagttccggggcttcagcgggagcccccgcttaccgagcactgtcagccgggtgcctgggccaaaatactgcgtatctgtcgacgtagacacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggtagacacgtagcagtctgagcgggctggcaaggc

SEQ ID NO: 491 - DNA, 495 bp, Artificial Sequence
  source: /note="Description of Artificial Sequence: Synthetic polynucleotide"
gcctccctcgcgccatcagcactgtacgtagcagtcgcacaaaaacccgagcgcagtctcgtccccggtcccccggcggccccagcttacccagcactgagagccgggtcccggcgccgaagtactgaatgttttgtcgaccactgtacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcactgtacgtagcagtctgagcgggctggcaaggc

SEQ ID NO: 492 - DNA, 495 bp, Artificial Sequence
  source: /note="Description of Artificial Sequence: Synthetic polynucleotide"
gcctccctcgcgccatcaggatgatccgtagcagtccccgcaaaaaccagacccaagccgcccgcgcccgcgccccagcagcccgcgctcaccgagcaccaggagccgcgtgcctggcccgaagtactgggtctcgtcgacgatgatccgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggatgatccgtagcagtctgagcgggctggcaaggc

SEQ ID NO: 493 - DNA, 495 bp, Artificial Sequence
  source: /note="Description of Artificial Sequence: Synthetic polynucleotide"
gcctccctcgcgccatcagcgccaatagtagcagtccgccgccttccacctgaatcccgccgcccgggtggtcccgcgaaaactcacccagcacggtcagcctgctgccggccccgaaagtcaggacgttggcccgtcgaccgccaatagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcgccaatagtagcagtctgagcgggctggcaaggc

SEQ ID NO: 494 - DNA, 495 bp, Artificial Sequence
  source: /note="Description of Artificial Sequence: Synthetic polynucleotide"
gcctccctcgcgccatcagtcaagcctgtagcagtccaccctccgactccggggaccgaggggctggaaggtggggagacgcccgaatctcacctgtgaccgtgagcctggtgcccggcccgaagtactgctcgtgtcgactcaagcctgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagtcaagcctgtagcagtctgagcgggctggcaaggc

SEQ ID NO: 495 - DNA, 495 bp, Artificial Sequence
  source: /note="Description of Artificial Sequence: Synthetic polynucleotide"
gcctccctcgcgccatcagagagtgtcatcttcgtctgtggacccacttttccctgtgacggatctgcaaaagaacctgaaaaatgtcttacctacaactgtgagtctggtgccttgtccaaagaaagcttcagtgtcgacagagtgtcatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaaagagtgtcatcttcgtctgagcgggctggcaaggc

SEQ ID NO: 496 - DNA, 495 bp, Artificial Sequence
  source: /note="Description of Artificial Sequence: Synthetic polynucleotide"
gcctccctcgcgccatcaggttccgaaatcttcgtatttcccaggacagagtcctccctcatcgcacccctcctagagacccccagccttacctacaacggttaacctggtccccgaaccgaaggtgtagccatagtcgacgttccgaaatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagttccgaaatcttcgtctgagcgggctggcaaggc

SEQ ID NO: 497 - DNA, 495 bp, Artificial Sequence
  source: /note="Description of Artificial Sequence: Synthetic polynucleotide"
gcctccctcgcgccatcagcgttacttatcttcgtctggattccagcccctttttgcaagttcccagctgtccagccttgacttactcacctacaacagtgagccaacttccctctccaaaatatatggtgtttcgtcgaccgttacttatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacgttacttatcttcgtctgagcgggctggcaaggc

SEQ ID NO: 498 - DNA, 495 bp, Artificial Sequence
  source: /note="Description of Artificial Sequence: Synthetic polynucleotide"
gcctccctcgcgccatcagtaggagacatcttcgtctcctggaactccgaccttatgatacactatcccgaaagaagtcttttacatacccaagacagagagctgggttccactgccaaaaaacagtttttcattgtcgactaggagacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaataggagacatcttcgtctgagcgggctggcaaggc

SEQ ID NO: 499 - DNA, 495 bp, Artificial Sequence
  source: /note="Description of Artificial Sequence: Synthetic polynucleotide"
gcctccctcgcgccatcaggacactctatcttcgtagagaactctgccttcaagggacaatggccataccaccctgattctgcaacttacctaggatggagagtcgagtcccatcaccaaaatgctggggctgatgtcgacgacactctatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagacactctatcttcgtctgagcgggctggcaaggc

SEQ ID NO: 500 - DNA, 495 bp, Artificial Sequence
  source: /note="Description of Artificial Sequence: Synthetic polynucleotide"
gcctccctcgcgccatcagttcggaacatcttcgtatcattgcagtcaaacccaggcacccccgagtcaagagtggagcccccatacctgtcacagtgagcctggtcccgttcccaaagtggaggggtgaattatgtcgacttcggaacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaattcggaacatcttcgtctgagcgggctggcaaggc

SEQ ID NO: 501 - DNA, 495 bp, Artificial Sequence
  source: /note="Description of Artificial Sequence: Synthetic polynucleotide"
gcctccctcgcgccatcagaagtaacgatcttcgtgggtcgtgcaggctgggctgctcaccctctctcccacctggagcccccttcttacctagcacggtgagccgtgtccctggcccgaagaactgctcattgtgtcgacaagtaacgatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaaaagtaacgatcttcgtctgagcgggctggcaaggc

SEQ ID NO: 502 - DNA, 495 bp, Artificial Sequence
  source: /note="Description of Artificial Sequence: Synthetic polynucleotide"
gcctccctcgcgccatcaggtctcctaatcttcgtcctctgcccatcccgccctctcggagctctccggagccccaaccgcctccttacccagtacggtcagcctagagccttctccaaaaaacagctccccggtgtcgacgtctcctaatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagtctcctaatcttcgtctgagcgggctggcaaggc

SEQ ID NO: 503 - DNA, 495 bp, Artificial Sequence
  source: /note="Description of Artificial Sequence: Synthetic polynucleotide"
gcctccctcgcgccatcaggtagacacatcttcgtgcgtcccggggcgccccctccccagttccggggcttcagcgggagcccccgcttaccgagcactgtcagccgggtgcctgggccaaaatactgcgtatctgtcgacgtagacacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagtagacacatcttcgtctgagcgggctggcaaggc

SEQ ID NO: 504 - DNA, 495 bp, Artificial Sequence
  source: /note="Description of Artificial Sequence: Synthetic polynucleotide"
gcctccctcgcgccatcagcactgtacatcttcgtcgcacaaaaacccgagcgcagtctcgtccccggtcccccggcggccccagcttacccagcactgagagccgggtcccggcgccgaagtactgaatgttttgtcgaccactgtacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacactgtacatcttcgtctgagcgggctggcaaggc

SEQ ID NO: 505 - DNA, 495 bp, Artificial Sequence
  source: /note="Description of Artificial Sequence: Synthetic polynucleotide"
gcctccctcgcgccatcaggatgatccatcttcgtccccgcaaaaaccagacccaagccgcccgcgcccgcgccccagcagcccgcgctcaccgagcaccaggagccgcgtgcctggcccgaagtactgggtctcgtcgacgatgatccatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagatgatccatcttcgtctgagcgggctggcaaggc

SEQ ID NO: 506 - DNA, 495 bp, Artificial Sequence
  source: /note="Description of Artificial Sequence: Synthetic polynucleotide"
gcctccctcgcgccatcagcgccaataatcttcgtccgccgccttccacctgaatcccgccgcccgggtggtcccgcgaaaactcacccagcacggtcagcctgctgccggccccgaaagtcaggacgttggcccgtcgaccgccaataatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacgccaataatcttcgtctgagcgggctggcaaggc

SEQ ID NO: 507 - DNA, 495 bp, Artificial Sequence
  source: /note="Description of Artificial Sequence: Synthetic polynucleotide"
gcctccctcgcgccatcagtcaagcctatcttcgtccaccctccgactccggggaccgaggggctggaaggtggggagacgcccgaatctcacctgtgaccgtgagcctggtgcccggcccgaagtactgctcgtgtcgactcaagcctatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaatcaagcctatcttcgtctgagcgggctggcaaggc

SEQ ID NO: 508 - DNA, 495 bp, Artificial Sequence
  source: /note="Description of Artificial Sequence: Synthetic polynucleotide"
gcctccctcgcgccatcagagagtgtctccacagtctgtggacccacttttccctgtgacggatctgcaaaagaacctgaaaaatgtcttacctacaactgtgagtctggtgccttgtccaaagaaagcttcagtgtcgacagagtgtctccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggagagtgtctccacagtctgagcgggctggcaaggc

SEQ ID NO: 509 - DNA, 495 bp, Artificial Sequence
  source: /note="Description of Artificial Sequence: Synthetic polynucleotide"
gcctccctcgcgccatcaggttccgaatccacagtatttcccaggacagagtcctccctcatcgcacccctcctagagacccccagccttacctacaacggttaacctggtccccgaaccgaaggtgtagccatagtcgacgttccgaatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggttccgaatccacagtctgagcgggctggcaaggc

SEQ ID NO: 510 - DNA, 495 bp, Artificial Sequence
  source: /note="Description of Artificial Sequence: Synthetic polynucleotide"
gcctccctcgcgccatcagcgttactttccacagtctggattccagcccctttttgcaagttcccagctgtccagccttgacttactcacctacaacagtgagccaacttccctctccaaaatatatggtgtttcgtcgaccgttactttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcgttactttccacagtctgagcgggctggcaaggc

SEQ ID NO: 511 - DNA, 495 bp, Artificial Sequence
  source: /note="Description of Artificial Sequence: Synthetic polynucleotide"
gcctccctcgcgccatcagtaggagactccacagtctcctggaactccgaccttatgatacactatcccgaaagaagtcttttacatacccaagacagagagctgggttccactgccaaaaaacagtttttcattgtcgactaggagactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggtaggagactccacagtctgagcgggctggcaaggc

SEQ ID NO: 512 - DNA, 495 bp, Artificial Sequence
  source: /note="Description of Artificial Sequence: Synthetic polynucleotide"
gcctccctcgcgccatcaggacactcttccacagtagagaactctgccttcaagggacaatggccataccaccctgattctgcaacttacctaggatggagagtcgagtcccatcaccaaaatgctggggctgatgtcgacgacactcttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggacactcttccacagtctgagcgggctggcaaggc

SEQ ID NO: 513 - DNA, 495 bp, Artificial Sequence
  source: /note="Description of Artificial Sequence: Synthetic polynucleotide"
gcctccctcgcgccatcagttcggaactccacagtatcattgcagtcaaacccaggcacccccgagtcaagagtggagcccccatacctgtcacagtgagcctggtcccgttcccaaagtggaggggtgaattatgtcgacttcggaactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggttcggaactccacagtctgagcgggctggcaaggc

SEQ ID NO: 514 - DNA, 495 bp, Artificial Sequence
  source: /note="Description of Artificial Sequence: Synthetic polynucleotide"
gcctccctcgcgccatcagaagtaacgtccacagtgggtcgtgcaggctgggctgctcaccctctctcccacctggagcccccttcttacctagcacggtgagccgtgtccctggcccgaagaactgctcattgtgtcgacaagtaacgtccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggaagtaacgtccacagtctgagcgggctggcaaggc

SEQ ID NO: 515 - DNA, 495 bp, Artificial Sequence
  source: /note="Description of Artificial Sequence: Synthetic polynucleotide"
gcctccctcgcgccatcaggtctcctatccacagtcctctgcccatcccgccctctcggagctctccggagccccaaccgcctccttacccagtacggtcagcctagagccttctccaaaaaacagctccccggtgtcgacgtctcctatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggtctcctatccacagtctgagcgggctggcaaggc

SEQ ID NO: 516 - DNA, 495 bp, Artificial Sequence
  source: /note="Description of Artificial Sequence: Synthetic polynucleotide"
gcctccctcgcgccatcaggtagacactccacagtgcgtcccggggcgccccctccccagttccggggcttcagcgggagcccccgcttaccgagcactgtcagccgggtgcctgggccaaaatactgcgtatctgtcgacgtagacactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggtagacactccacagtctgagcgggctggcaaggc

SEQ ID NO: 517 - DNA, 495 bp, Artificial Sequence
  source: /note="Description of Artificial Sequence: Synthetic polynucleotide"
gcctccctcgcgccatcagcactgtactccacagtcgcacaaaaacccgagcgcagtctcgtccccggtcccccggcggccccagcttacccagcactgagagccgggtcccggcgccgaagtactgaatgttttgtcgaccactgtactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcactgtactccacagtctgagcgggctggcaaggc

SEQ ID NO: 518 - DNA, 495 bp, Artificial Sequence
  source: /note="Description of Artificial Sequence: Synthetic polynucleotide"
gcctccctcgcgccatcaggatgatcctccacagtccccgcaaaaaccagacccaagccgcccgcgcccgcgccccagcagcccgcgctcaccgagcaccaggagccgcgtgcctggcccgaagtactgggtctcgtcgacgatgatcctccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggatgatcctccacagtctgagcgggctggcaaggc

SEQ ID NO: 519 - DNA, 495 bp, Artificial Sequence
  source: /note="Description of Artificial Sequence: Synthetic polynucleotide"
gcctccctcgcgccatcagcgccaatatccacagtccgccgccttccacctgaatcccgccgcccgggtggtcccgcgaaaactcacccagcacggtcagcctgctgccggccccgaaagtcaggacgttggcccgtcgaccgccaatatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcgccaatatccacagtctgagcgggctggcaaggc

SEQ ID NO: 520 - DNA, 495 bp, Artificial Sequence
  source: /note="Description of Artificial Sequence: Synthetic polynucleotide"
gcctccctcgcgccatcagtcaagccttccacagtccaccctccgactccggggaccgaggggctggaaggtggggagacgcccgaatctcacctgtgaccgtgagcctggtgcccggcccgaagtactgctcgtgtcgactcaagccttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggtcaagccttccacagtctgagcgggctggcaaggc

SEQ ID NO: 521 - DNA, 495 bp, Artificial Sequence
  source: /note="Description of Artificial Sequence: Synthetic polynucleotide"
gcctccctcgcgccatcagagagtgtcatgacaccctgtggacccacttttccctgtgacggatctgcaaaagaacctgaaaaatgtcttacctacaactgtgagtctggtgccttgtccaaagaaagcttcagtgtcgacagagtgtcatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagagagtgtcatgacaccctgagcgggctggcaaggc

SEQ ID NO: 522 - DNA, 495 bp, Artificial Sequence
  source: /note="Description of Artificial Sequence: Synthetic polynucleotide"
gcctccctcgcgccatcaggttccgaaatgacaccatttcccaggacagagtcctccctcatcgcacccctcctagagacccccagccttacctacaacggttaacctggtccccgaaccgaaggtgtagccatagtcgacgttccgaaatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggttccgaaatgacaccctgagcgggctggcaaggc

SEQ ID NO: 523 - DNA, 495 bp, Artificial Sequence
  source: /note="Description of Artificial Sequence: Synthetic polynucleotide"
gcctccctcgcgccatcagcgttacttatgacaccctggattccagcccctttttgcaagttcccagctgtccagccttgacttactcacctacaacagtgagccaacttccctctccaaaatatatggtgtttcgtcgaccgttacttatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcgttacttatgacaccctgagcgggctggcaaggc

SEQ ID NO: 524 - DNA, 495 bp, Artificial Sequence
  source: /note="Description of Artificial Sequence: Synthetic polynucleotide"
gcctccctcgcgccatcagtaggagacatgacaccctcctggaactccgaccttatgatacactatcccgaaagaagtcttttacatacccaagacagagagctgggttccactgccaaaaaacagtttttcattgtcgactaggagacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagtaggagacatgacaccctgagcgggctggcaaggc

SEQ ID NO: 525 - DNA, 495 bp, Artificial Sequence
  source: /note="Description of Artificial Sequence: Synthetic polynucleotide"
gcctccctcgcgccatcaggacactctatgacaccagagaactctgccttcaagggacaatggccataccaccctgattctgcaacttacctaggatggagagtcgagtcccatcaccaaaatgctggggctgatgtcgacgacactctatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggacactctatgacaccctgagcgggctggcaaggc

SEQ ID NO: 526 - DNA, 495 bp, Artificial Sequence
  source: /note="Description of Artificial Sequence: Synthetic polynucleotide"
gcctccctcgcgccatcagttcggaacatgacaccatcattgcagtcaaacccaggcacccccgagtcaagagtggagcccccatacctgtcacagtgagcctggtcccgttcccaaagtggaggggtgaattatgtcgacttcggaacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagttcggaacatgacaccctgagcgggctggcaaggc

SEQ ID NO: 527 - DNA, 495 bp, Artificial Sequence
  source: /note="Description of Artificial Sequence: Synthetic polynucleotide"
gcctccctcgcgccatcagaagtaacgatgacaccgggtcgtgcaggctgggctgctcaccctctctcccacctggagcccccttcttacctagcacggtgagccgtgtccctggcccgaagaactgctcattgtgtcgacaagtaacgatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagaagtaacgatgacaccctgagcgggctggcaaggc

SEQ ID NO: 528 - DNA, 495 bp, Artificial Sequence
  source: /note="Description of Artificial Sequence: Synthetic polynucleotide"
gcctccctcgcgccatcaggtctcctaatgacacccctctgcccatcccgccctctcggagctctccggagccccaaccgcctccttacccagtacggtcagcctagagccttctccaaaaaacagctccccggtgtcgacgtctcctaatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggtctcctaatgacaccctgagcgggctggcaaggc

SEQ ID NO: 529 - DNA, 495 bp, Artificial Sequence
  source: /note="Description of Artificial Sequence: Synthetic polynucleotide"
gcctccctcgcgccatcaggtagacacatgacaccgcgtcccggggcgccccctccccagttccggggcttcagcgggagcccccgcttaccgagcactgtcagccgggtgcctgggccaaaatactgcgtatctgtcgacgtagacacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggtagacacatgacaccctgagcgggctggcaaggc

SEQ ID NO: 530 - DNA, 495 bp, Artificial Sequence
  source: /note="Description of Artificial Sequence: Synthetic polynucleotide"
gcctccctcgcgccatcagcactgtacatgacacccgcacaaaaacccgagcgcagtctcgtccccggtcccccggcggccccagcttacccagcactgagagccgggtcccggcgccgaagtactgaatgttttgtcgaccactgtacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcactgtacatgacaccctgagcgggctggcaaggc

SEQ ID NO: 531 - DNA, 495 bp, Artificial Sequence
  source: /note="Description of Artificial Sequence: Synthetic polynucleotide"
gcctccctcgcgccatcaggatgatccatgacaccccccgcaaaaaccagacccaagccgcccgcgcccgcgccccagcagcccgcgctcaccgagcaccaggagccgcgtgcctggcccgaagtactgggtctcgtcgacgatgatccatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggatgatccatgacaccctgagcgggctggcaaggc

SEQ ID NO: 532 - DNA, 495 bp, Artificial Sequence
  source: /note="Description of Artificial Sequence: Synthetic polynucleotide"
gcctccctcgcgccatcagcgccaataatgacaccccgccgccttccacctgaatcccgccgcccgggtggtcccgcgaaaactcacccagcacggtcagcctgctgccggccccgaaagtcaggacgttggcccgtcgaccgccaataatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcgccaataatgacaccctgagcgggctggcaaggc

SEQ ID NO: 533 - DNA, 495 bp, Artificial Sequence
  source: /note="Description of Artificial Sequence: Synthetic polynucleotide"
gcctccctcgcgccatcagtcaagcctatgacaccccaccctccgactccggggaccgaggggctggaaggtggggagacgcccgaatctcacctgtgaccgtgagcctggtgcccggcccgaagtactgctcgtgtcgactcaagcctatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagtcaagcctatgacaccctgagcgggctggcaaggc

SEQ ID NO: 534 - DNA, 495 bp, Artificial Sequence
  source: /note="Description of Artificial Sequence: Synthetic polynucleotide"
gcctccctcgcgccatcagagagtgtccttcacgactgtggacccacttttccctgtgacggatctgcaaaagaacctgaaaaatgtcttacctacaactgtgagtctggtgccttgtccaaagaaagcttcagtgtcgacagagtgtccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggagagtgtccttcacgactgagcgggctggcaaggc

SEQ ID NO: 535 - DNA, 495 bp, Artificial Sequence
  source: /note="Description of Artificial Sequence: Synthetic polynucleotide"
gcctccctcgcgccatcaggttccgaacttcacgaatttcccaggacagagtcctccctcatcgcacccctcctagagacccccagccttacctacaacggttaacctggtccccgaaccgaaggtgtagccatagtcgacgttccgaacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggttccgaacttcacgactgagcgggctggcaaggc

SEQ ID NO: 536 - DNA, 495 bp, Artificial Sequence
  source: /note="Description of Artificial Sequence: Synthetic polynucleotide"
gcctccctcgcgccatcagcgttacttcttcacgactggattccagcccctttttgcaagttcccagctgtccagccttgacttactcacctacaacagtgagccaacttccctctccaaaatatatggtgtttcgtcgaccgttacttcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcgttacttcttcacgactgagcgggctggcaaggc

SEQ ID NO: 537 - DNA, 495 bp, Artificial Sequence
  source: /note="Description of Artificial Sequence: Synthetic polynucleotide"
gcctccctcgcgccatcagtaggagaccttcacgactcctggaactccgaccttatgatacactatcccgaaagaagtcttttacatacccaagacagagagctgggttccactgccaaaaaacagtttttcattgtcgactaggagaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggtaggagaccttcacgactgagcgggctggcaaggc

SEQ ID NO: 538 - DNA, 495 bp, Artificial Sequence
  source: /note="Description of Artificial Sequence: Synthetic polynucleotide"
gcctccctcgcgccatcaggacactctcttcacgaagagaactctgccttcaagggacaatggccataccaccctgattctgcaacttacctaggatggagagtcgagtcccatcaccaaaatgctggggctgatgtcgacgacactctcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggacactctcttcacgactgagcgggctggcaaggc

SEQ ID NO: 539 - DNA, 495 bp, Artificial Sequence
  source: /note="Description of Artificial Sequence: Synthetic polynucleotide"
gcctccctcgcgccatcagttcggaaccttcacgaatcattgcagtcaaacccaggcacccccgagtcaagagtggagcccccatacctgtcacagtgagcctggtcccgttcccaaagtggaggggtgaattatgtcgacttcggaaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggttcggaaccttcacgactgagcgggctggcaaggc

SEQ ID NO: 540 - DNA, 495 bp, Artificial Sequence
  source: /note="Description of Artificial Sequence: Synthetic polynucleotide"
gcctccctcgcgccatcagaagtaacgcttcacgagggtcgtgcaggctgggctgctcaccctctctcccacctggagcccccttcttacctagcacggtgagccgtgtccctggcccgaagaactgctcattgtgtcgacaagtaacgcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggaagtaacgcttcacgactgagcgggctggcaaggc

SEQ ID NO: 541 - DNA, 495 bp, Artificial Sequence
  source: /note="Description of Artificial Sequence: Synthetic polynucleotide"
gcctccctcgcgccatcaggtctcctacttcacgacctctgcccatcccgccctctcggagctctccggagccccaaccgcctccttacccagtacggtcagcctagagccttctccaaaaaacagctccccggtgtcgacgtctcctacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggtctcctacttcacgactgagcgggctggcaaggc

SEQ ID NO: 542 - DNA, 495 bp, Artificial Sequence
  source: /note="Description of Artificial Sequence: Synthetic polynucleotide"
gcctccctcgcgccatcaggtagacaccttcacgagcgtcccggggcgccccctccccagttccggggcttcagcgggagcccccgcttaccgagcactgtcagccgggtgcctgggccaaaatactgcgtatctgtcgacgtagacaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggtagacaccttcacgactgagcgggctggcaaggc

SEQ ID NO: 543 - DNA, 495 bp, Artificial Sequence
  source: /note="Description of Artificial Sequence: Synthetic polynucleotide"
gcctccctcgcgccatcagcactgtaccttcacgacgcacaaaaacccgagcgcagtctcgtccccggtcccccggcggccccagcttacccagcactgagagccgggtcccggcgccgaagtactgaatgttttgtcgaccactgtaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcactgtaccttcacgactgagcgggctggcaaggc

SEQ ID NO: 544 - DNA, 495 bp, Artificial Sequence
  source: /note="Description of Artificial Sequence: Synthetic polynucleotide"
gcctccctcgcgccatcaggatgatcccttcacgaccccgcaaaaaccagacccaagccgcccgcgcccgcgccccagcagcccgcgctcaccgagcaccaggagccgcgtgcctggcccgaagtactgggtctcgtcgacgatgatcccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggatgatcccttcacgactgagcgggctggcaaggc

SEQ ID NO: 545 - DNA, 495 bp, Artificial Sequence
  source: /note="Description of Artificial Sequence: Synthetic polynucleotide"
gcctccctcgcgccatcagcgccaatacttcacgaccgccgccttccacctgaatcccgccgcccgggtggtcccgcgaaaactcacccagcacggtcagcctgctgccggccccgaaagtcaggacgttggcccgtcgaccgccaatacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcgccaatacttcacgactgagcgggctggcaaggc

SEQ ID NO: 546 - DNA, 495 bp, Artificial Sequence
  source: /note="Description of Artificial Sequence: Synthetic polynucleotide"
gcctccctcgcgccatcagtcaagcctcttcacgaccaccctccgactccggggaccgaggggctggaaggtggggagacgcccgaatctcacctgtgaccgtgagcctggtgcccggcccgaagtactgctcgtgtcgactcaagcctcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggtcaagcctcttcacgactgagcgggctggcaaggc

SEQ ID NO: 547 - DNA, 495 bp, Artificial Sequence
  source: /note="Description of Artificial Sequence: Synthetic polynucleotide"
gcctccctcgcgccatcagagagtgtcagctagtgctgtggacccacttttccctgtgacggatctgcaaaagaacctgaaaaatgtcttacctacaactgtgagtctggtgccttgtccaaagaaagcttcagtgtcgacagagtgtcagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaaagagtgtcagctagtgctgagcgggctggcaaggc

SEQ ID NO: 548 - DNA, 495 bp, Artificial Sequence
  source: /note="Description of Artificial Sequence: Synthetic polynucleotide"
gcctccctcgcgccatcaggttccgaaagctagtgatttcccaggacagagtcctccctcatcgcacccctcctagagacccccagccttacctacaacggttaacctggtccccgaaccgaaggtgtagccatagtcgacgttccgaaagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagttccgaaagctagtgctgagcgggctggcaaggc

SEQ ID NO: 549 - DNA, 495 bp, Artificial Sequence
  source: /note="Description of Artificial Sequence: Synthetic polynucleotide"
gcctccctcgcgccatcagcgttacttagctagtgctggattccagcccctttttgcaagttcccagctgtccagccttgacttactcacctacaacagtgagccaacttccctctccaaaatatatggtgtttcgtcgaccgttacttagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacgttacttagctagtgctgagcgggctggcaaggc

SEQ ID NO: 550 - DNA, 495 bp, Artificial Sequence
  source: /note="Description of Artificial Sequence: Synthetic polynucleotide"
gcctccctcgcgccatcagtaggagacagctagtgctcctggaactccgaccttatgatacactatcccgaaagaagtcttttacatacccaagacagagagctgggttccactgccaaaaaacagtttttcattgtcgactaggagacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaataggagacagctagtgctgagcgggctggcaaggc

SEQ ID NO: 551 - DNA, 495 bp, Artificial Sequence
  source: /note="Description of Artificial Sequence: Synthetic polynucleotide"
gcctccctcgcgccatcaggacactctagctagtgagagaactctgccttcaagggacaatggccataccaccctgattctgcaacttacctaggatggagagtcgagtcccatcaccaaaatgctggggctgatgtcgacgacactctagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagacactctagctagtgctgagcgggctggcaaggc

SEQ ID NO: 552 - DNA, 495 bp, Artificial Sequence
  source: /note="Description of Artificial Sequence: Synthetic polynucleotide"
gcctccctcgcgccatcagttcggaacagctagtgatcattgcagtcaaacccaggcacccccgagtcaagagtggagcccccatacctgtcacagtgagcctggtcccgttcccaaagtggaggggtgaattatgtcgacttcggaacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaattcggaacagctagtgctgagcgggctggcaaggc

SEQ ID NO: 553 - DNA, 495 bp, Artificial Sequence
  source: /note="Description of Artificial Sequence: Synthetic polynucleotide"
gcctccctcgcgccatcagaagtaacgagctagtggggtcgtgcaggctgggctgctcaccctctctcccacctggagcccccttcttacctagcacggtgagccgtgtccctggcccgaagaactgctcattgtgtcgacaagtaacgagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaaaagtaacgagctagtgctgagcgggctggcaaggc

SEQ ID NO: 554 - DNA, 495 bp, Artificial Sequence
  source: /note="Description of Artificial Sequence: Synthetic polynucleotide"
gcctccctcgcgccatcaggtctcctaagctagtgcctctgcccatcccgccctctcggagctctccggagccccaaccgcctccttacccagtacggtcagcctagagccttctccaaaaaacagctccccggtgtcgacgtctcctaagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagtctcctaagctagtgctgagcgggctggcaaggc

SEQ ID NO: 555 - DNA, 495 bp, Artificial Sequence
  source: /note="Description of Artificial Sequence: Synthetic polynucleotide"
gcctccctcgcgccatcaggtagacacagctagtggcgtcccggggcgccccctccccagttccggggcttcagcgggagcccccgcttaccgagcactgtcagccgggtgcctgggccaaaatactgcgtatctgtcgacgtagacacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagtagacacagctagtgctgagcgggctggcaaggc

SEQ ID NO: 556 - DNA, 495 bp, Artificial Sequence
  source: /note="Description of Artificial Sequence: Synthetic polynucleotide"
gcctccctcgcgccatcagcactgtacagctagtgcgcacaaaaacccgagcgcagtctcgtccccggtcccccggcggccccagcttacccagcactgagagccgggtcccggcgccgaagtactgaatgttttgtcgaccactgtacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacactgtacagctagtgctgagcgggctggcaaggc

SEQ ID NO: 557 - DNA, 495 bp, Artificial Sequence
  source: /note="Description of Artificial Sequence: Synthetic polynucleotide"
gcctccctcgcgccatcaggatgatccagctagtgccccgcaaaaaccagacccaagccgcccgcgcccgcgccccagcagcccgcgctcaccgagcaccaggagccgcgtgcctggcccgaagtactgggtctcgtcgacgatgatccagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagatgatccagctagtgctgagcgggctggcaaggc

SEQ ID NO: 558 - DNA, 495 bp, Artificial Sequence
  source: /note="Description of Artificial Sequence: Synthetic polynucleotide"
gcctccctcgcgccatcagcgccaataagctagtgccgccgccttccacctgaatcccgccgcccgggtggtcccgcgaaaactcacccagcacggtcagcctgctgccggccccgaaagtcaggacgttggcccgtcgaccgccaataagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacgccaataagctagtgctgagcgggctggcaaggc

SEQ ID NO: 559 - DNA, 495 bp, Artificial Sequence
  source: /note="Description of Artificial Sequence: Synthetic polynucleotide"
gcctccctcgcgccatcagtcaagcctagctagtgccaccctccgactccggggaccgaggggctggaaggtggggagacgcccgaatctcacctgtgaccgtgagcctggtgcccggcccgaagtactgctcgtgtcgactcaagcctagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaatcaagcctagctagtgctgagcgggctggcaaggc

SEQ ID NO: 560 - DNA, 495 bp, Artificial Sequence
  source: /note="Description of Artificial Sequence: Synthetic polynucleotide"
gcctccctcgcgccatcagagagtgtctaaccaagctgtggacccacttttccctgtgacggatctgcaaaagaacctgaaaaatgtcttacctacaactgtgagtctggtgccttgtccaaagaaagcttcagtgtcgacagagtgtctaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaaagagtgtctaaccaagctgagcgggctggcaaggc

SEQ ID NO: 561 - DNA, 495 bp, Artificial Sequence
  source: /note="Description of Artificial Sequence: Synthetic polynucleotide"
gcctccctcgcgccatcaggttccgaataaccaagatttcccaggacagagtcctccctcatcgcacccctcctagagacccccagccttacctacaacggttaacctggtccccgaaccgaaggtgtagccatagtcgacgttccgaataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagttccgaataaccaagctgagcgggctggcaaggc

SEQ ID NO: 562 - DNA, 495 bp, Artificial Sequence
  source: /note="Description of Artificial Sequence: Synthetic polynucleotide"
gcctccctcgcgccatcagcgttactttaaccaagctggattccagcccctttttgcaagttcccagctgtccagccttgacttactcacctacaacagtgagccaacttccctctccaaaatatatggtgtttcgtcgaccgttactttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacgttactttaaccaagctgagcgggctggcaaggc

SEQ ID NO: 563 - DNA, 495 bp, Artificial Sequence
  source: /note="Description of Artificial Sequence: Synthetic polynucleotide"
gcctccctcgcgccatcagtaggagactaaccaagctcctggaactccgaccttatgatacactatcccgaaagaagtcttttacatacccaagacagagagctgggttccactgccaaaaaacagtttttcattgtcgactaggagactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaataggagactaaccaagctgagcgggctggcaaggc

SEQ ID NO: 564 - DNA, 495 bp, Artificial Sequence
  source: /note="Description of Artificial Sequence: Synthetic polynucleotide"
gcctccctcgcgccatcaggacactcttaaccaagagagaactctgccttcaagggacaatggccataccaccctgattctgcaacttacctaggatggagagtcgagtcccatcaccaaaatgctggggctgatgtcgacgacactcttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagacactcttaaccaagctgagcgggctggcaaggc

SEQ ID NO: 565 - DNA, 495 bp, Artificial Sequence
  source: /note="Description of Artificial Sequence: Synthetic polynucleotide"
gcctccctcgcgccatcagttcggaactaaccaagatcattgcagtcaaacccaggcacccccgagtcaagagtggagcccccatacctgtcacagtgagcctggtcccgttcccaaagtggaggggtgaattatgtcgacttcggaactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaattcggaactaaccaagctgagcgggctggcaaggc

SEQ ID NO: 566 - DNA, 495 bp, Artificial Sequence
  source: /note="Description of Artificial Sequence: Synthetic polynucleotide"
gcctccctcgcgccatcagaagtaacgtaaccaaggggtcgtgcaggctgggctgctcaccctctctcccacctggagcccccttcttacctagcacggtgagccgtgtccctggcccgaagaactgctcattgtgtcgacaagtaacgtaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaaaagtaacgtaaccaagctgagcgggctggcaaggc

SEQ ID NO: 567 - DNA, 495 bp, Artificial Sequence
  source: /note="Description of Artificial Sequence: Synthetic polynucleotide"
gcctccctcgcgccatcaggtctcctataaccaagcctctgcccatcccgccctctcggagctctccggagccccaaccgcctccttacccagtacggtcagcctagagccttctccaaaaaacagctccccggtgtcgacgtctcctataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagtctcctataaccaagctgagcgggctggcaaggc

SEQ ID NO: 568 - DNA, 495 bp, Artificial Sequence
  source: /note="Description of Artificial Sequence: Synthetic polynucleotide"
gcctccctcgcgccatcaggtagacactaaccaaggcgtcccggggcgccccctccccagttccggggcttcagcgggagcccccgcttaccgagcactgtcagccgggtgcctgggccaaaatactgcgtatctgtcgacgtagacactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagtagacactaaccaagctgagcgggctggcaaggc

SEQ ID NO: 569 - DNA, 495 bp, Artificial Sequence
  source: /note="Description of Artificial Sequence: Synthetic polynucleotide"
gcctccctcgcgccatcagcactgtactaaccaagcgcacaaaaacccgagcgcagtctcgtccccggtcccccggcggccccagcttacccagcactgagagccgggtcccggcgccgaagtactgaatgttttgtcgaccactgtactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacactgtactaaccaagctgagcgggctggcaaggc

SEQ ID NO: 570 - DNA, 495 bp, Artificial Sequence
  source: /note="Description of Artificial Sequence: Synthetic polynucleotide"
gcctccctcgcgccatcaggatgatcctaaccaagccccgcaaaaaccagacccaagccgcccgcgcccgcgccccagcagcccgcgctcaccgagcaccaggagccgcgtgcctggcccgaagtactgggtctcgtcgacgatgatcctaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagatgatcctaaccaagctgagcgggctggcaaggc

SEQ ID NO: 571 - DNA, 495 bp, Artificial Sequence
  source: /note="Description of Artificial Sequence: Synthetic polynucleotide"
gcctccctcgcgccatcagcgccaatataaccaagccgccgccttccacctgaatcccgccgcccgggtggtcccgcgaaaactcacccagcacggtcagcctgctgccggccccgaaagtcaggacgttggcccgtcgaccgccaatataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacgccaatataaccaagctgagcgggctggcaaggc

SEQ ID NO: 572 - DNA, 495 bp, Artificial Sequence
  source: /note="Description of Artificial Sequence: Synthetic polynucleotide"
gcctccctcgcgccatcagtcaagccttaaccaagccaccctccgactccggggaccgaggggctggaaggtggggagacgcccgaatctcacctgtgaccgtgagcctggtgcccggcccgaagtactgctcgtgtcgactcaagccttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaatcaagccttaaccaagctgagcgggctggcaaggc

SEQ ID NO: 573 - DNA, 495 bp, Artificial Sequence
  source: /note="Description of Artificial Sequence: Synthetic polynucleotide"
gcctccctcgcgccatcagagagtgtccaagaggtctgtggacccacttttccctgtgacggatctgcaaaagaacctgaaaaatgtcttacctacaactgtgagtctggtgccttgtccaaagaaagcttcagtgtcgacagagtgtccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaaagagtgtccaagaggtctgagcgggctggcaaggc

SEQ ID NO: 574 - DNA, 495 bp, Artificial Sequence
  source: /note="Description of Artificial Sequence: Synthetic polynucleotide"
gcctccctcgcgccatcaggttccgaacaagaggtatttcccaggacagagtcctccctcatcgcacccctcctagagacccccagccttacctacaacggttaacctggtccccgaaccgaaggtgtagccatagtcgacgttccgaacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagttccgaacaagaggtctgagcgggctggcaaggc

SEQ ID NO: 575 - DNA, 495 bp, Artificial Sequence
  source: /note="Description of Artificial Sequence: Synthetic polynucleotide"
gcctccctcgcgccatcagcgttacttcaagaggtctggattccagcccctttttgcaagttcccagctgtccagccttgacttactcacctacaacagtgagccaacttccctctccaaaatatatggtgtttcgtcgaccgttacttcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacgttacttcaagaggtctgagcgggctggcaaggc

SEQ ID NO: 576 - DNA, 495 bp, Artificial Sequence
  source: /note="Description of Artificial Sequence: Synthetic polynucleotide"
gcctccctcgcgccatcagtaggagaccaagaggtctcctggaactccgaccttatgatacactatcccgaaagaagtcttttacatacccaagacagagagctgggttccactgccaaaaaacagtttttcattgtcgactaggagaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaataggagaccaagaggtctgagcgggctggcaaggc

SEQ ID NO: 577 - DNA, 495 bp, Artificial Sequence
  source: /note="Description of Artificial Sequence: Synthetic polynucleotide"
gcctccctcgcgccatcaggacactctcaagaggtagagaactctgccttcaagggacaatggccataccaccctgattctgcaacttacctaggatggagagtcgagtcccatcaccaaaatgctggggctgatgtcgacgacactctcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagacactctcaagaggtctgagcgggctggcaaggc

SEQ ID NO: 578 - DNA, 495 bp, Artificial Sequence
  source: /note="Description of Artificial Sequence: Synthetic polynucleotide"
gcctccctcgcgccatcagttcggaaccaagaggtatcattgcagtcaaacccaggcacccccgagtcaagagtggagcccccatacctgtcacagtgagcctggtcccgttcccaaagtggaggggtgaattatgtcgacttcggaaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaattcggaaccaagaggtctgagcgggctggcaaggc

SEQ ID NO: 579 - DNA, 495 bp, Artificial Sequence
  source: /note="Description of Artificial Sequence: Synthetic polynucleotide"
gcctccctcgcgccatcagaagtaacgcaagaggtgggtcgtgcaggctgggctgctcaccctctctcccacctggagcccccttcttacctagcacggtgagccgtgtccctggcccgaagaactgctcattgtgtcgacaagtaacgcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaaaagtaacgcaagaggtctgagcgggctggcaaggc

SEQ ID NO: 580 - DNA, 495 bp, Artificial Sequence
  source: /note="Description of Artificial Sequence: Synthetic polynucleotide"
gcctccctcgcgccatcaggtctcctacaagaggtcctctgcccatcccgccctctcggagctctccggagccccaaccgcctccttacccagtacggtcagcctagagccttctccaaaaaacagctccccggtgtcgacgtctcctacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagtctcctacaagaggtctgagcgggctggcaaggc

SEQ ID NO: 581 - DNA, 495 bp, Artificial Sequence
  source: /note="Description of Artificial Sequence: Synthetic polynucleotide"
gcctccctcgcgccatcaggtagacaccaagaggtgcgtcccggggcgccccctccccagttccggggcttcagcgggagcccccgcttaccgagcactgtcagccgggtgcctgggccaaaatactgcgtatctgtcgacgtagacaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagtagacaccaagaggtctgagcgggctggcaaggc

SEQ ID NO: 582 - DNA, 495 bp, Artificial Sequence
  source: /note="Description of Artificial Sequence: Synthetic polynucleotide"
gcctccctcgcgccatcagcactgtaccaagaggtcgcacaaaaacccgagcgcagtctcgtccccggtcccccggcggccccagcttacccagcactgagagccgggtcccggcgccgaagtactgaatgttttgtcgaccactgtaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacactgtaccaagaggtctgagcgggctggcaaggc

SEQ ID NO: 583 - DNA, 495 bp, Artificial Sequence
  source: /note="Description of Artificial Sequence: Synthetic polynucleotide"
gcctccctcgcgccatcaggatgatcccaagaggtccccgcaaaaaccagacccaagccgcccgcgcccgcgccccagcagcccgcgctcaccgagcaccaggagccgcgtgcctggcccgaagtactgggtctcgtcgacgatgatcccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagatgatcccaagaggtctgagcgggctggcaaggc

SEQ ID NO: 584 - DNA, 495 bp, Artificial Sequence
  source: /note="Description of Artificial Sequence: Synthetic polynucleotide"
gcctccctcgcgccatcagcgccaatacaagaggtccgccgccttccacctgaatcccgccgcccgggtggtcccgcgaaaactcacccagcacggtcagcctgctgccggccccgaaagtcaggacgttggcccgtcgaccgccaatacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacgccaatacaagaggtctgagcgggctggcaaggc

SEQ ID NO: 585 - DNA, 495 bp, Artificial Sequence
  source: /note="Description of Artificial Sequence: Synthetic polynucleotide"
gcctccctcgcgccatcagtcaagcctcaagaggtccaccctccgactccggggaccgaggggctggaaggtggggagacgcccgaatctcacctgtgaccgtgagcctggtgcccggcccgaagtactgctcgtgtcgactcaagcctcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaatcaagcctcaagaggtctgagcgggctggcaaggc

SEQ ID NO: 586 - DNA, 495 bp, Artificial Sequence
  source: /note="Description of Artificial Sequence: Synthetic polynucleotide"
gcctccctcgcgccatcagagagtgtcagaatcagctgtggacccacttttccctgtgacggatctgcaaaagaacctgaaaaatgtcttacctacaactgtgagtctggtgccttgtccaaagaaagcttcagtgtcgacagagtgtcagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagagagtgtcagaatcagctgagcgggctggcaaggc

SEQ ID NO: 587 - DNA, 495 bp, Artificial Sequence
  source: /note="Description of Artificial Sequence: Synthetic polynucleotide"
gcctccctcgcgccatcaggttccgaaagaatcagatttcccaggacagagtcctccctcatcgcacccctcctagagacccccagccttacctacaacggttaacctggtccccgaaccgaaggtgtagccatagtcgacgttccgaaagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggttccgaaagaatcagctgagcgggctggcaaggc

SEQ ID NO: 588 - DNA, 495 bp, Artificial Sequence
  source: /note="Description of Artificial Sequence: Synthetic polynucleotide"
gcctccctcgcgccatcagcgttacttagaatcagctggattccagcccctttttgcaagttcccagctgtccagccttgacttactcacctacaacagtgagccaacttccctctccaaaatatatggtgtttcgtcgaccgttacttagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcgttacttagaatcagctgagcgggctggcaaggc

SEQ ID NO: 589 - DNA, 495 bp, Artificial Sequence
  source: /note="Description of Artificial Sequence: Synthetic polynucleotide"
gcctccctcgcgccatcagtaggagacagaatcagctcctggaactccgaccttatgatacactatcccgaaagaagtcttttacatacccaagacagagagctgggttccactgccaaaaaacagtttttcattgtcgactaggagacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagtaggagacagaatcagctgagcgggctggcaaggc

SEQ ID NO: 590 - DNA, 495 bp, Artificial Sequence
  source: /note="Description of Artificial Sequence: Synthetic polynucleotide"
gcctccctcgcgccatcaggacactctagaatcagagagaactctgccttcaagggacaatggccataccaccctgattctgcaacttacctaggatggagagtcgagtcccatcaccaaaatgctggggctgatgtcgacgacactctagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggacactctagaatcagctgagcgggctggcaaggc

SEQ ID NO: 591 - DNA, 495 bp, Artificial Sequence
  source: /note="Description of Artificial Sequence: Synthetic polynucleotide"
gcctccctcgcgccatcagttcggaacagaatcagatcattgcagtcaaacccaggcacccccgagtcaagagtggagcccccatacctgtcacagtgagcctggtcccgttcccaaagtggaggggtgaattatgtcgacttcggaacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagttcggaacagaatcagctgagcgggctggcaaggc

SEQ ID NO: 592 - DNA, 495 bp, Artificial Sequence
  source: /note="Description of Artificial Sequence: Synthetic polynucleotide"
gcctccctcgcgccatcagaagtaacgagaatcaggggtcgtgcaggctgggctgctcaccctctctcccacctggagcccccttcttacctagcacggtgagccgtgtccctggcccgaagaactgctcattgtgtcgacaagtaacgagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagaagtaacgagaatcagctgagcgggctggcaaggc

SEQ ID NO: 593 - DNA, 495 bp, Artificial Sequence
  source: /note="Description of Artificial Sequence: Synthetic polynucleotide"
gcctccctcgcgccatcaggtctcctaagaatcagcctctgcccatcccgccctctcggagctctccggagccccaaccgcctccttacccagtacggtcagcctagagccttctccaaaaaacagctccccggtgtcgacgtctcctaagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggtctcctaagaatcagctgagcgggctggcaaggc

SEQ ID NO: 594 - DNA, 495 bp, Artificial Sequence
  source: /note="Description of Artificial Sequence: Synthetic polynucleotide"
gcctccctcgcgccatcaggtagacacagaatcaggcgtcccggggcgccccctccccagttccggggcttcagcgggagcccccgcttaccgagcactgtcagccgggtgcctgggccaaaatactgcgtatctgtcgacgtagacacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggtagacacagaatcagctgagcgggctggcaaggc

SEQ ID NO: 595 - DNA, 495 bp, Artificial Sequence
  source: /note="Description of Artificial Sequence: Synthetic polynucleotide"
gcctccctcgcgccatcagcactgtacagaatcagcgcacaaaaacccgagcgcagtctcgtccccggtcccccggcggccccagcttacccagcactgagagccgggtcccggcgccgaagtactgaatgttttgtcgaccactgtacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcactgtacagaatcagctgagcgggctggcaaggc

SEQ ID NO: 596 - DNA, 495 bp, Artificial Sequence
  source: /note="Description of Artificial Sequence: Synthetic polynucleotide"
gcctccctcgcgccatcaggatgatccagaatcagccccgcaaaaaccagacccaagccgcccgcgcccgcgccccagcagcccgcgctcaccgagcaccaggagccgcgtgcctggcccgaagtactgggtctcgtcgacgatgatccagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggatgatccagaatcagctgagcgggctggcaaggc

SEQ ID NO: 597 - DNA, 495 bp, Artificial Sequence
  source: /note="Description of Artificial Sequence: Synthetic polynucleotide"
gcctccctcgcgccatcagcgccaataagaatcagccgccgccttccacctgaatcccgccgcccgggtggtcccgcgaaaactcacccagcacggtcagcctgctgccggccccgaaagtcaggacgttggcccgtcgaccgccaataagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcgccaataagaatcagctgagcgggctggcaaggc

SEQ ID NO: 598 - DNA, 495 bp, Artificial Sequence
  source: /note="Description of Artificial Sequence: Synthetic polynucleotide"
gcctccctcgcgccatcagtcaagcctagaatcagccaccctccgactccggggaccgaggggctggaaggtggggagacgcccgaatctcacctgtgaccgtgagcctggtgcccggcccgaagtactgctcgtgtcgactcaagcctagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagtcaagcctagaatcagctgagcgggctggcaaggc

SEQ ID NO: 599 - DNA, 495 bp, Artificial Sequence
  source: /note="Description of Artificial Sequence: Synthetic polynucleotide"
gcctccctcgcgccatcagagagtgtcagttgaccctgtggacccacttttccctgtgacggatctgcaaaagaacctgaaaaatgtcttacctacaactgtgagtctggtgccttgtccaaagaaagcttcagtgtcgacagagtgtcagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaaagagtgtcagttgaccctgagcgggctggcaaggc

SEQ ID NO: 600 - DNA, 495 bp, Artificial Sequence
  source: /note="Description of Artificial Sequence: Synthetic polynucleotide"
gcctccctcgcgccatcaggttccgaaagttgaccatttcccaggacagagtcctccctcatcgcacccctcctagagacccccagccttacctacaacggttaacctggtccccgaaccgaaggtgtagccatagtcgacgttccgaaagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagttccgaaagttgaccctgagcgggctggcaaggc

SEQ ID NO: 601 - DNA, 495 bp, Artificial Sequence
  source: /note="Description of Artificial Sequence: Synthetic polynucleotide"
gcctccctcgcgccatcagcgttacttagttgaccctggattccagcccctttttgcaagttcccagctgtccagccttgacttactcacctacaacagtgagccaacttccctctccaaaatatatggtgtttcgtcgaccgttacttagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacgttacttagttgaccctgagcgggctggcaaggc

SEQ ID NO: 602 - DNA, 495 bp, Artificial Sequence
  source: /note="Description of Artificial Sequence: Synthetic polynucleotide"
gcctccctcgcgccatcagtaggagacagttgaccctcctggaactccgaccttatgatacactatcccgaaagaagtcttttacatacccaagacagagagctgggttccactgccaaaaaacagtttttcattgtcgactaggagacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaataggagacagttgaccctgagcgggctggcaaggc

SEQ ID NO: 603 - DNA, 495 bp, Artificial Sequence
  source: /note="Description of Artificial Sequence: Synthetic polynucleotide"
gcctccctcgcgccatcaggacactctagttgaccagagaactctgccttcaagggacaatggccataccaccctgattctgcaacttacctaggatggagagtcgagtcccatcaccaaaatgctggggctgatgtcgacgacactctagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagacactctagttgaccctgagcgggctggcaaggc

SEQ ID NO: 604 - DNA, 495 bp, Artificial Sequence
  source: /note="Description of Artificial Sequence: Synthetic polynucleotide"
gcctccctcgcgccatcagttcggaacagttgaccatcattgcagtcaaacccaggcacccccgagtcaagagtggagcccccatacctgtcacagtgagcctggtcccgttcccaaagtggaggggtgaattatgtcgacttcggaacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaattcggaacagttgaccctgagcgggctggcaaggc

SEQ ID NO: 605 - DNA, 495 bp, Artificial Sequence
  source: /note="Description of Artificial Sequence: Synthetic polynucleotide"
gcctccctcgcgccatcagaagtaacgagttgaccgggtcgtgcaggctgggctgctcaccctctctcccacctggagcccccttcttacctagcacggtgagccgtgtccctggcccgaagaactgctcattgtgtcgacaagtaacgagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaaaagtaacgagttgaccctgagcgggctggcaaggc

SEQ ID NO: 606 - DNA, 495 bp, Artificial Sequence
  source: /note="Description of Artificial Sequence: Synthetic polynucleotide"
gcctccctcgcgccatcaggtctcctaagttgacccctctgcccatcccgccctctcggagctctccggagccccaaccgcctccttacccagtacggtcagcctagagccttctccaaaaaacagctccccggtgtcgacgtctcctaagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagtctcctaagttgaccctgagcgggctggcaaggc

SEQ ID NO: 607 - DNA, 495 bp, Artificial Sequence
  source: /note="Description of Artificial Sequence: Synthetic polynucleotide"
gcctccctcgcgccatcaggtagacacagttgaccgcgtcccggggcgccccctccccagttccggggcttcagcgggagcccccgcttaccgagcactgtcagccgggtgcctgggccaaaatactgcgtatctgtcgacgtagacacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagtagacacagttgaccctgagcgggctggcaaggc

SEQ ID NO: 608 - DNA, 495 bp, Artificial Sequence
  source: /note="Description of Artificial Sequence: Synthetic polynucleotide"
gcctccctcgcgccatcagcactgtacagttgacccgcacaaaaacccgagcgcagtctcgtccccggtcccccggcggccccagcttacccagcactgagagccgggtcccggcgccgaagtactgaatgttttgtcgaccactgtacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacactgtacagttgaccctgagcgggctggcaaggc

SEQ ID NO: 609 - DNA, 495 bp, Artificial Sequence
  source: /note="Description of Artificial Sequence: Synthetic polynucleotide"
gcctccctcgcgccatcaggatgatccagttgaccccccgcaaaaaccagacccaagccgcccgcgcccgcgccccagcagcccgcgctcaccgagcaccaggagccgcgtgcctggcccgaagtactgggtctcgtcgacgatgatccagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagatgatccagttgaccctgagcgggctggcaaggc

SEQ ID NO: 610 - DNA, 495 bp, Artificial Sequence
  source: /note="Description of Artificial Sequence: Synthetic polynucleotide"
gcctccctcgcgccatcagcgccaataagttgaccccgccgccttccacctgaatcccgccgcccgggtggtcccgcgaaaactcacccagcacggtcagcctgctgccggccccgaaagtcaggacgttggcccgtcgaccgccaataagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacgccaataagttgaccctgagcgggctggcaaggc

SEQ ID NO: 611 - DNA, 495 bp, Artificial Sequence
  source: /note="Description of Artificial Sequence: Synthetic polynucleotide"
gcctccctcgcgccatcagtcaagcctagttgaccccaccctccgactccggggaccgaggggctggaaggtggggagacgcccgaatctcacctgtgaccgtgagcctggtgcccggcccgaagtactgctcgtgtcgactcaagcctagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaatcaagcctagttgaccctgagcgggctggcaaggc

SEQ ID NO: 612 - DNA, 495 bp, Artificial Sequence
  source: /note="Description of Artificial Sequence: Synthetic polynucleotide"
gcctccctcgcgccatcagagagtgtcagttatgcctgtggacccacttttccctgtgacggatctgcaaaagaacctgaaaaatgtcttacctacaactgtgagtctggtgccttgtccaaagaaagcttcagtgtcgacagagtgtcagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaaagagtgtcagttatgcctgagcgggctggcaaggc

SEQ ID NO: 613 - DNA, 495 bp, Artificial Sequence
  source: /note="Description of Artificial Sequence: Synthetic polynucleotide"
gcctccctcgcgccatcaggttccgaaagttatgcatttcccaggacagagtcctccctcatcgcacccctcctagagacccccagccttacctacaacggttaacctggtccccgaaccgaaggtgtagccatagtcgacgttccgaaagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagttccgaaagttatgcctgagcgggctggcaaggc

SEQ ID NO: 614 - DNA, 495 bp, Artificial Sequence
  source: /note="Description of Artificial Sequence: Synthetic polynucleotide"
gcctccctcgcgccatcagcgttacttagttatgcctggattccagcccctttttgcaagttcccagctgtccagccttgacttactcacctacaacagtgagccaacttccctctccaaaatatatggtgtttcgtcgaccgttacttagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacgttacttagttatgcctgagcgggctggcaaggc

SEQ ID NO: 615 - DNA, 495 bp, Artificial Sequence
  source: /note="Description of Artificial Sequence: Synthetic polynucleotide"
gcctccctcgcgccatcagtaggagacagttatgcctcctggaactccgaccttatgatacactatcccgaaagaagtcttttacatacccaagacagagagctgggttccactgccaaaaaacagtttttcattgtcgactaggagacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaataggagacagttatgcctgagcgggctggcaaggc

SEQ ID NO: 616 - DNA, 495 bp, Artificial Sequence
  source: /note="Description of Artificial Sequence: Synthetic polynucleotide"
gcctccctcgcgccatcaggacactctagttatgcagagaactctgccttcaagggacaatggccataccaccctgattctgcaacttacctaggatggagagtcgagtcccatcaccaaaatgctggggctgatgtcgacgacactctagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagacactctagttatgcctgagcgggctggcaaggc

SEQ ID NO: 617 - DNA, 495 bp, Artificial Sequence
  source: /note="Description of Artificial Sequence: Synthetic polynucleotide"
gcctccctcgcgccatcagttcggaacagttatgcatcattgcagtcaaacccaggcacccccgagtcaagagtggagcccccatacctgtcacagtgagcctggtcccgttcccaaagtggaggggtgaattatgtcgacttcggaacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaattcggaacagttatgcctgagcgggctggcaaggc

SEQ ID NO: 618 - DNA, 495 bp, Artificial Sequence
  source: /note="Description of Artificial Sequence: Synthetic polynucleotide"
gcctccctcgcgccatcagaagtaacgagttatgcgggtcgtgcaggctgggctgctcaccctctctcccacctggagcccccttcttacctagcacggtgagccgtgtccctggcccgaagaactgctcattgtgtcgacaagtaacgagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaaaagtaacgagttatgcctgagcgggctggcaaggc

SEQ ID NO: 619 - DNA, 495 bp, Artificial Sequence
  source: /note="Description of Artificial Sequence: Synthetic polynucleotide"
gcctccctcgcgccatcaggtctcctaagttatgccctctgcccatcccgccctctcggagctctccggagccccaaccgcctccttacccagtacggtcagcctagagccttctccaaaaaacagctccccggtgtcgacgtctcctaagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagtctcctaagttatgcctgagcgggctggcaaggc

SEQ ID NO: 620 - DNA, 495 bp, Artificial Sequence
  source: /note="Description of Artificial Sequence: Synthetic polynucleotide"
gcctccctcgcgccatcaggtagacacagttatgcgcgtcccggggcgccccctccccagttccggggcttcagcgggagcccccgcttaccgagcactgtcagccgggtgcctgggccaaaatactgcgtatctgtcgacgtagacacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagtagacacagttatgcctgagcgggctggcaaggc

SEQ ID NO: 621 - DNA, 495 bp, Artificial Sequence
  source: /note="Description of Artificial Sequence: Synthetic polynucleotide"
gcctccctcgcgccatcagcactgtacagttatgccgcacaaaaacccgagcgcagtctcgtccccggtcccccggcggccccagcttacccagcactgagagccgggtcccggcgccgaagtactgaatgttttgtcgaccactgtacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacactgtacagttatgcctgagcgggctggcaaggc

SEQ ID NO: 622 - DNA, 495 bp, Artificial Sequence
  source: /note="Description of Artificial Sequence: Synthetic polynucleotide"
gcctccctcgcgccatcaggatgatccagttatgcccccgcaaaaaccagacccaagccgcccgcgcccgcgccccagcagcccgcgctcaccgagcaccaggagccgcgtgcctggcccgaagtactgggtctcgtcgacgatgatccagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagatgatccagttatgcctgagcgggctggcaaggc

SEQ ID NO: 623 - DNA, 495 bp, Artificial Sequence
  source: /note="Description of Artificial Sequence: Synthetic polynucleotide"
gcctccctcgcgccatcagcgccaataagttatgcccgccgccttccacctgaatcccgccgcccgggtggtcccgcgaaaactcacccagcacggtcagcctgctgccggccccgaaagtcaggacgttggcccgtcgaccgccaataagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacgccaataagttatgcctgagcgggctggcaaggc

SEQ ID NO: 624 - DNA, 495 bp, Artificial Sequence
  source: /note="Description of Artificial Sequence: Synthetic polynucleotide"
gcctccctcgcgccatcagtcaagcctagttatgcccaccctccgactccggggaccgaggggctggaaggtggggagacgcccgaatctcacctgtgaccgtgagcctggtgcccggcccgaagtactgctcgtgtcgactcaagcctagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaatcaagcctagttatgcctgagcgggctggcaaggc

SEQ ID NO: 625 - DNA, 495 bp, Artificial Sequence
  source: /note="Description of Artificial Sequence: Synthetic polynucleotide"
gcctccctcgcgccatcagagagtgtccagcatatctgtggacccacttttccctgtgacggatctgcaaaagaacctgaaaaatgtcttacctacaactgtgagtctggtgccttgtccaaagaaagcttcagtgtcgacagagtgtccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggaagagtgtccagcatatctgagcgggctggcaaggc

SEQ ID NO: 626 - DNA, 495 bp, Artificial Sequence
  source: /note="Description of Artificial Sequence: Synthetic polynucleotide"
gcctccctcgcgccatcaggttccgaacagcatatatttcccaggacagagtcctccctcatcgcacccctcctagagacccccagccttacctacaacggttaacctggtccccgaaccgaaggtgtagccatagtcgacgttccgaacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagttccgaacagcatatctgagcgggctggcaaggc

SEQ ID NO: 627 - DNA, 495 bp, Artificial Sequence
  source: /note="Description of Artificial Sequence: Synthetic polynucleotide"
gcctccctcgcgccatcagcgttacttcagcatatctggattccagcccctttttgcaagttcccagctgtccagccttgacttactcacctacaacagtgagccaacttccctctccaaaatatatggtgtttcgtcgaccgttacttcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacgttacttcagcatatctgagcgggctggcaaggc

SEQ ID NO: 628 - DNA, 495 bp, Artificial Sequence
  source: /note="Description of Artificial Sequence: Synthetic polynucleotide"
gcctccctcgcgccatcagtaggagaccagcatatctcctggaactccgaccttatgatacactatcccgaaagaagtcttttacatacccaagacagagagctgggttccactgccaaaaaacagtttttcattgtcgactaggagaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggataggagaccagcatatctgagcgggctggcaaggc

SEQ ID NO: 629 - DNA, 495 bp, Artificial Sequence
  source: /note="Description of Artificial Sequence: Synthetic polynucleotide"
gcctccctcgcgccatcaggacactctcagcatatagagaactctgccttcaagggacaatggccataccaccctgattctgcaacttacctaggatggagagtcgagtcccatcaccaaaatgctggggctgatgtcgacgacactctcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagacactctcagcatatctgagcgggctggcaaggc

SEQ ID NO: 630 - DNA, 495 bp, Artificial Sequence
  source: /note="Description of Artificial Sequence: Synthetic polynucleotide"
gcctccctcgcgccatcagttcggaaccagcatatatcattgcagtcaaacccaggcacccccgagtcaagagtggagcccccatacctgtcacagtgagcctggtcccgttcccaaagtggaggggtgaattatgtcgacttcggaaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggattcggaaccagcatatctgagcgggctggcaaggc

SEQ ID NO: 631 - DNA, 495 bp, Artificial Sequence
  source: /note="Description of Artificial Sequence: Synthetic polynucleotide"
gcctccctcgcgccatcagaagtaacgcagcatatgggtcgtgcaggctgggctgctcaccctctctcccacctggagcccccttcttacctagcacggtgagccgtgtccctggcccgaagaactgctcattgtgtcgacaagtaacgcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggaaagtaacgcagcatatctgagcgggctggcaaggc

SEQ ID NO: 632 - DNA, 495 bp, Artificial Sequence
  source: /note="Description of Artificial Sequence: Synthetic polynucleotide"
gcctccctcgcgccatcaggtctcctacagcatatcctctgcccatcccgccctctcggagctctccggagccccaaccgcctccttacccagtacggtcagcctagagccttctccaaaaaacagctccccggtgtcgacgtctcctacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagtctcctacagcatatctgagcgggctggcaaggc

SEQ ID NO: 633 - DNA, 495 bp, Artificial Sequence
  source: /note="Description of Artificial Sequence: Synthetic polynucleotide"
gcctccctcgcgccatcaggtagacaccagcatatgcgtcccggggcgccccctccccagttccggggcttcagcgggagcccccgcttaccgagcactgtcagccgggtgcctgggccaaaatactgcgtatctgtcgacgtagacaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagtagacaccagcatatctgagcgggctggcaaggc

SEQ ID NO: 634 - DNA, 495 bp, Artificial Sequence
  source: /note="Description of Artificial Sequence: Synthetic polynucleotide"
gcctccctcgcgccatcagcactgtaccagcatatcgcacaaaaacccgagcgcagtctcgtccccggtcccccggcggccccagcttacccagcactgagagccgggtcccggcgccgaagtactgaatgttttgtcgaccactgtaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacactgtaccagcatatctgagcgggctggcaaggc

SEQ ID NO: 635 - DNA, 495 bp, Artificial Sequence
  source: /note="Description of Artificial Sequence: Synthetic polynucleotide"
gcctccctcgcgccatcaggatgatcccagcatatccccgcaaaaaccagacccaagccgcccgcgcccgcgccccagcagcccgcgctcaccgagcaccaggagccgcgtgcctggcccgaagtactgggtctcgtcgacgatgatcccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagatgatcccagcatatctgagcgggctggcaaggc

SEQ ID NO: 636 - DNA, 495 bp, Artificial Sequence
  source: /note="Description of Artificial Sequence: Synthetic polynucleotide"
gcctccctcgcgccatcagcgccaatacagcatatccgccgccttccacctgaatcccgccgcccgggtggtcccgcgaaaactcacccagcacggtcagcctgctgccggccccgaaagtcaggacgttggcccgtcgaccgccaatacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacgccaatacagcatatctgagcgggctggcaaggc

SEQ ID NO: 637 - DNA, 495 bp, Artificial Sequence
  source: /note="Description of Artificial Sequence: Synthetic polynucleotide"
gcctccctcgcgccatcagtcaagcctcagcatatccaccctccgactccggggaccgaggggctggaaggtggggagacgcccgaatctcacctgtgaccgtgagcctggtgcccggcccgaagtactgctcgtgtcgactcaagcctcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggatcaagcctcagcatatctgagcgggctggcaaggc

SEQ ID NO: 638 - DNA, 495 bp, Artificial Sequence
  source: /note="Description of Artificial Sequence: Synthetic polynucleotide"
gcctccctcgcgccatcagagagtgtcgcaggattctgtggacccacttttccctgtgacggatctgcaaaagaacctgaaaaatgtcttacctacaactgtgagtctggtgccttgtccaaagaaagcttcagtgtcgacagagtgtcgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaaagagtgtcgcaggattctgagcgggctggcaaggc

SEQ ID NO: 639 - DNA, 495 bp, Artificial Sequence
  source: /note="Description of Artificial Sequence: Synthetic polynucleotide"
gcctccctcgcgccatcaggttccgaagcaggattatttcccaggacagagtcctccctcatcgcacccctcctagagacccccagccttacctacaacggttaacctggtccccgaaccgaaggtgtagccatagtcgacgttccgaagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagttccgaagcaggattctgagcgggctggcaaggc

SEQ ID NO: 640 - DNA, 495 bp, Artificial Sequence
  source: /note="Description of Artificial Sequence: Synthetic polynucleotide"
gcctccctcgcgccatcagcgttacttgcaggattctggattccagcccctttttgcaagttcccagctgtccagccttgacttactcacctacaacagtgagccaacttccctctccaaaatatatggtgtttcgtcgaccgttacttgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacgttacttgcaggattctgagcgggctggcaaggc

SEQ ID NO: 641 - DNA, 495 bp, Artificial Sequence
  source: /note="Description of Artificial Sequence: Synthetic polynucleotide"
gcctccctcgcgccatcagtaggagacgcaggattctcctggaactccgaccttatgatacactatcccgaaagaagtcttttacatacccaagacagagagctgggttccactgccaaaaaacagtttttcattgtcgactaggagacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaataggagacgcaggattctgagcgggctggcaaggc

SEQ ID NO: 642 - DNA, 495 bp, Artificial Sequence
  source: /note="Description of Artificial Sequence: Synthetic polynucleotide"
gcctccctcgcgccatcaggacactctgcaggattagagaactctgccttcaagggacaatggccataccaccctgattctgcaacttacctaggatggagagtcgagtcccatcaccaaaatgctggggctgatgtcgacgacactctgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagacactctgcaggattctgagcgggctggcaaggc

SEQ ID NO: 643 - DNA, 495 bp, Artificial Sequence
  source: /note="Description of Artificial Sequence: Synthetic polynucleotide"
gcctccctcgcgccatcagttcggaacgcaggattatcattgcagtcaaacccaggcacccccgagtcaagagtggagcccccatacctgtcacagtgagcctggtcccgttcccaaagtggaggggtgaattatgtcgacttcggaacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaattcggaacgcaggattctgagcgggctggcaaggc

SEQ ID NO: 644 - DNA, 495 bp, Artificial Sequence
  source: /note="Description of Artificial Sequence: Synthetic polynucleotide"
gcctccctcgcgccatcagaagtaacggcaggattgggtcgtgcaggctgggctgctcaccctctctcccacctggagcccccttcttacctagcacggtgagccgtgtccctggcccgaagaactgctcattgtgtcgacaagtaacggcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaaaagtaacggcaggattctgagcgggctggcaaggc

SEQ ID NO: 645 - DNA, 495 bp, Artificial Sequence
  source: /note="Description of Artificial Sequence: Synthetic polynucleotide"
gcctccctcgcgccatcaggtctcctagcaggattcctctgcccatcccgccctctcggagctctccggagccccaaccgcctccttacccagtacggtcagcctagagccttctccaaaaaacagctccccggtgtcgacgtctcctagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagtctcctagcaggattctgagcgggctggcaaggc

SEQ ID NO: 646 - DNA, 495 bp, Artificial Sequence
  source: /note="Description of Artificial Sequence: Synthetic polynucleotide"
gcctccctcgcgccatcaggtagacacgcaggattgcgtcccggggcgccccctccccagttccggggcttcagcgggagcccccgcttaccgagcactgtcagccgggtgcctgggccaaaatactgcgtatctgtcgacgtagacacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagtagacacgcaggattctgagcgggctggcaaggc

SEQ ID NO: 647 - DNA, 495 bp, Artificial Sequence
  source: /note="Description of Artificial Sequence: Synthetic polynucleotide"
gcctccctcgcgccatcagcactgtacgcaggattcgcacaaaaacccgagcgcagtctcgtccccggtcccccggcggccccagcttacccagcactgagagccgggtcccggcgccgaagtactgaatgttttgtcgaccactgtacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacactgtacgcaggattctgagcgggctggcaaggc

SEQ ID NO: 648 - DNA, 495 bp, Artificial Sequence
  source: /note="Description of Artificial Sequence: Synthetic polynucleotide"
gcctccctcgcgccatcaggatgatccgcaggattccccgcaaaaaccagacccaagccgcccgcgcccgcgccccagcagcccgcgctcaccgagcaccaggagccgcgtgcctggcccgaagtactgggtctcgtcgacgatgatccgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagatgatccgcaggattctgagcgggctggcaaggc

SEQ ID NO: 649 - DNA, 495 bp, Artificial Sequence
  source: /note="Description of Artificial Sequence: Synthetic polynucleotide"
gcctccctcgcgccatcagcgccaatagcaggattccgccgccttccacctgaatcccgccgcccgggtggtcccgcgaaaactcacccagcacggtcagcctgctgccggccccgaaagtcaggacgttggcccgtcgaccgccaatagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacgccaatagcaggattctgagcgggctggcaaggc

SEQ ID NO: 650 - DNA, 495 bp, Artificial Sequence
  source: /note="Description of Artificial Sequence: Synthetic polynucleotide"
gcctccctcgcgccatcagtcaagcctgcaggattccaccctccgactccggggaccgaggggctggaaggtggggagacgcccgaatctcacctgtgaccgtgagcctggtgcccggcccgaagtactgctcgtgtcgactcaagcctgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaatcaagcctgcaggattctgagcgggctggcaaggc

SEQ ID NO: 651 - DNA, 495 bp, Artificial Sequence
  source: /note="Description of Artificial Sequence: Synthetic polynucleotide"
gcctccctcgcgccatcagagagtgtcaggtctcactgtggacccacttttccctgtgacggatctgcaaaagaacctgaaaaatgtcttacctacaactgtgagtctggtgccttgtccaaagaaagcttcagtgtcgacagagtgtcaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagagagtgtcaggtctcactgagcgggctggcaaggc

SEQ ID NO: 652 - DNA, 495 bp, Artificial Sequence
  source: /note="Description of Artificial Sequence: Synthetic polynucleotide"
gcctccctcgcgccatcaggttccgaaaggtctcaatttcccaggacagagtcctccctcatcgcacccctcctagagacccccagccttacctacaacggttaacctggtccccgaaccgaaggtgtagccatagtcgacgttccgaaaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggttccgaaaggtctcactgagcgggctggcaaggc

SEQ ID NO: 653 - DNA, 495 bp, Artificial Sequence
  source: /note="Description of Artificial Sequence: Synthetic polynucleotide"
gcctccctcgcgccatcagcgttacttaggtctcactggattccagcccctttttgcaagttcccagctgtccagccttgacttactcacctacaacagtgagccaacttccctctccaaaatatatggtgtttcgtcgaccgttacttaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcgttacttaggtctcactgagcgggctggcaaggc

SEQ ID NO: 654 - DNA, 495 bp, Artificial Sequence
  source: /note="Description of Artificial Sequence: Synthetic polynucleotide"
gcctccctcgcgccatcagtaggagacaggtctcactcctggaactccgaccttatgatacactatcccgaaagaagtcttttacatacccaagacagagagctgggttccactgccaaaaaacagtttttcattgtcgactaggagacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagtaggagacaggtctcactgagcgggctggcaaggc

SEQ ID NO: 655 - DNA, 495 bp, Artificial Sequence
  source: /note="Description of Artificial Sequence: Synthetic polynucleotide"
gcctccctcgcgccatcaggacactctaggtctcaagagaactctgccttcaagggacaatggccataccaccctgattctgcaacttacctaggatggagagtcgagtcccatcaccaaaatgctggggctgatgtcgacgacactctaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggacactctaggtctcactgagcgggctggcaaggc

SEQ ID NO: 656 - DNA, 495 bp, Artificial Sequence
  source: /note="Description of Artificial Sequence: Synthetic polynucleotide"
gcctccctcgcgccatcagttcggaacaggtctcaatcattgcagtcaaacccaggcacccccgagtcaagagtggagcccccatacctgtcacagtgagcctggtcccgttcccaaagtggaggggtgaattatgtcgacttcggaacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagttcggaacaggtctcactgagcgggctggcaaggc

SEQ ID NO: 657 - DNA, 495 bp, Artificial Sequence
  source: /note="Description of Artificial Sequence: Synthetic polynucleotide"
gcctccctcgcgccatcagaagtaacgaggtctcagggtcgtgcaggctgggctgctcaccctctctcccacctggagcccccttcttacctagcacggtgagccgtgtccctggcccgaagaactgctcattgtgtcgacaagtaacgaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagaagtaacgaggtctcactgagcgggctggcaaggc

SEQ ID NO: 658 - DNA, 495 bp, Artificial Sequence
  source: /note="Description of Artificial Sequence: Synthetic polynucleotide"
gcctccctcgcgccatcaggtctcctaaggtctcacctctgcccatcccgccctctcggagctctccggagccccaaccgcctccttacccagtacggtcagcctagagccttctccaaaaaacagctccccggtgtcgacgtctcctaaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggtctcctaaggtctcactgagcgggctggcaaggc

SEQ ID NO: 659 - DNA, 495 bp, Artificial Sequence
  source: /note="Description of Artificial Sequence: Synthetic polynucleotide"
gcctccctcgcgccatcaggtagacacaggtctcagcgtcccggggcgccccctccccagttccggggcttcagcgggagcccccgcttaccgagcactgtcagccgggtgcctgggccaaaatactgcgtatctgtcgacgtagacacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggtagacacaggtctcactgagcgggctggcaaggc

SEQ ID NO: 660 - DNA, 495 bp, Artificial Sequence
  source: /note="Description of Artificial Sequence: Synthetic polynucleotide"
gcctccctcgcgccatcagcactgtacaggtctcacgcacaaaaacccgagcgcagtctcgtccccggtcccccggcggccccagcttacccagcactgagagccgggtcccggcgccgaagtactgaatgttttgtcgaccactgtacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcactgtacaggtctcactgagcgggctggcaaggc

SEQ ID NO: 661 - DNA, 495 bp, Artificial Sequence
  source: /note="Description of Artificial Sequence: Synthetic polynucleotide"
gcctccctcgcgccatcaggatgatccaggtctcaccccgcaaaaaccagacccaagccgcccgcgcccgcgccccagcagcccgcgctcaccgagcaccaggagccgcgtgcctggcccgaagtactgggtctcgtcgacgatgatccaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggatgatccaggtctcactgagcgggctggcaaggc

SEQ ID NO: 662 - DNA, 495 bp, Artificial Sequence
  source: /note="Description of Artificial Sequence: Synthetic polynucleotide"
gcctccctcgcgccatcagcgccaataaggtctcaccgccgccttccacctgaatcccgccgcccgggtggtcccgcgaaaactcacccagcacggtcagcctgctgccggccccgaaagtcaggacgttggcccgtcgaccgccaataaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcgccaataaggtctcactgagcgggctggcaaggc

SEQ ID NO: 663 - DNA, 495 bp, Artificial Sequence
  source: /note="Description of Artificial Sequence: Synthetic polynucleotide"
gcctccctcgcgccatcagtcaagcctaggtctcaccaccctccgactccggggaccgaggggctggaaggtggggagacgcccgaatctcacctgtgaccgtgagcctggtgcccggcccgaagtactgctcgtgtcgactcaagcctaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagtcaagcctaggtctcactgagcgggctggcaaggc

SEQ ID NO: 664 - DNA, 495 bp, Artificial Sequence
  source: /note="Description of Artificial Sequence: Synthetic polynucleotide"
gcctccctcgcgccatcagagagtgtcgtccattcctgtggacccacttttccctgtgacggatctgcaaaagaacctgaaaaatgtcttacctacaactgtgagtctggtgccttgtccaaagaaagcttcagtgtcgacagagtgtcgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaaagagtgtcgtccattcctgagcgggctggcaaggc

SEQ ID NO: 665 - DNA, 495 bp, Artificial Sequence
  source: /note="Description of Artificial Sequence: Synthetic polynucleotide"
gcctccctcgcgccatcaggttccgaagtccattcatttcccaggacagagtcctccctcatcgcacccctcctagagacccccagccttacctacaacggttaacctggtccccgaaccgaaggtgtagccatagtcgacgttccgaagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagttccgaagtccattcctgagcgggctggcaaggc

SEQ ID NO: 666 - DNA, 495 bp, Artificial Sequence
  source: /note="Description of Artificial Sequence: Synthetic polynucleotide"
gcctccctcgcgccatcagcgttacttgtccattcctggattccagcccctttttgcaagttcccagctgtccagccttgacttactcacctacaacagtgagccaacttccctctccaaaatatatggtgtttcgtcgaccgttacttgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacgttacttgtccattcctgagcgggctggcaaggc

SEQ ID NO: 667 - DNA, 495 bp, Artificial Sequence
  source: /note="Description of Artificial Sequence: Synthetic polynucleotide"
gcctccctcgcgccatcagtaggagacgtccattcctcctggaactccgaccttatgatacactatcccgaaagaagtcttttacatacccaagacagagagctgggttccactgccaaaaaacagtttttcattgtcgactaggagacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaataggagacgtccattcctgagcgggctggcaaggc

SEQ ID NO: 668 - DNA, 495 bp, Artificial Sequence
  source: /note="Description of Artificial Sequence: Synthetic polynucleotide"
gcctccctcgcgccatcaggacactctgtccattcagagaactctgccttcaagggacaatggccataccaccctgattctgcaacttacctaggatggagagtcgagtcccatcaccaaaatgctggggctgatgtcgacgacactctgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagacactctgtccattcctgagcgggctggcaaggc

SEQ ID NO: 669 - DNA, 495 bp, Artificial Sequence
  source: /note="Description of Artificial Sequence: Synthetic polynucleotide"
gcctccctcgcgccatcagttcggaacgtccattcatcattgcagtcaaacccaggcacccccgagtcaagagtggagcccccatacctgtcacagtgagcctggtcccgttcccaaagtggaggggtgaattatgtcgacttcggaacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaattcggaacgtccattcctgagcgggctggcaaggc

SEQ ID NO: 670 - DNA, 495 bp, Artificial Sequence
  source: /note="Description of Artificial Sequence: Synthetic polynucleotide"
gcctccctcgcgccatcagaagtaacggtccattcgggtcgtgcaggctgggctgctcaccctctctcccacctggagcccccttcttacctagcacggtgagccgtgtccctggcccgaagaactgctcattgtgtcgacaagtaacggtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaaaagtaacggtccattcctgagcgggctggcaaggc

SEQ ID NO: 671 - DNA, 495 bp, Artificial Sequence
  source: /note="Description of Artificial Sequence: Synthetic polynucleotide"
gcctccctcgcgccatcaggtctcctagtccattccctctgcccatcccgccctctcggagctctccggagccccaaccgcctccttacccagtacggtcagcctagagccttctccaaaaaacagctccccggtgtcgacgtctcctagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagtctcctagtccattcctgagcgggctggcaaggc

SEQ ID NO: 672 - DNA, 495 bp, Artificial Sequence
  source: /note="Description of Artificial Sequence: Synthetic polynucleotide"
gcctccctcgcgccatcaggtagacacgtccattcgcgtcccggggcgccccctccccagttccggggcttcagcgggagcccccgcttaccgagcactgtcagccgggtgcctgggccaaaatactgcgtatctgtcgacgtagacacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagtagacacgtccattcctgagcgggctggcaaggc

SEQ ID NO: 673 - DNA, 495 bp, Artificial Sequence
  source: /note="Description of Artificial Sequence: Synthetic polynucleotide"
gcctccctcgcgccatcagcactgtacgtccattccgcacaaaaacccgagcgcagtctcgtccccggtcccccggcggccccagcttacccagcactgagagccgggtcccggcgccgaagtactgaatgttttgtcgaccactgtacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacactgtacgtccattcctgagcgggctggcaaggc

SEQ ID NO: 674 - DNA, 495 bp, Artificial Sequence
  source: /note="Description of Artificial Sequence: Synthetic polynucleotide"
gcctccctcgcgccatcaggatgatccgtccattcccccgcaaaaaccagacccaagccgcccgcgcccgcgccccagcagcccgcgctcaccgagcaccaggagccgcgtgcctggcccgaagtactgggtctcgtcgacgatgatccgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagatgatccgtccattcctgagcgggctggcaaggc

SEQ ID NO: 675 - DNA, 495 bp, Artificial Sequence
  source: /note="Description of Artificial Sequence: Synthetic polynucleotide"
gcctccctcgcgccatcagcgccaatagtccattcccgccgccttccacctgaatcccgccgcccgggtggtcccgcgaaaactcacccagcacggtcagcctgctgccggccccgaaagtcaggacgttggcccgtcgaccgccaatagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacgccaatagtccattcctgagcgggctggcaaggc

SEQ ID NO: 676 - DNA, 495 bp, Artificial Sequence
  source: /note="Description of Artificial Sequence: Synthetic polynucleotide"
gcctccctcgcgccatcagtcaagcctgtccattcccaccctccgactccggggaccgaggggctggaaggtggggagacgcccgaatctcacctgtgaccgtgagcctggtgcccggcccgaagtactgctcgtgtcgactcaagcctgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaatcaagcctgtccattcctgagcgggctggcaaggc

SEQ ID NO: 677 - DNA, 495 bp, Artificial Sequence
  source: /note="Description of Artificial Sequence: Synthetic polynucleotide"
gcctccctcgcgccatcagagagtgtcgcataactctgtggacccacttttccctgtgacggatctgcaaaagaacctgaaaaatgtcttacctacaactgtgagtctggtgccttgtccaaagaaagcttcagtgtcgacagagtgtcgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggagagtgtcgcataactctgagcgggctggcaaggc

SEQ ID NO: 678 - DNA, 495 bp, Artificial Sequence
  source: /note="Description of Artificial Sequence: Synthetic polynucleotide"
gcctccctcgcgccatcaggttccgaagcataactatttcccaggacagagtcctccctcatcgcacccctcctagagacccccagccttacctacaacggttaacctggtccccgaaccgaaggtgtagccatagtcgacgttccgaagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggttccgaagcataactctgagcgggctggcaaggc

SEQ ID NO: 679 - DNA, 495 bp, Artificial Sequence
  source: /note="Description of Artificial Sequence: Synthetic polynucleotide"
gcctccctcgcgccatcagcgttacttgcataactctggattccagcccctttttgcaagttcccagctgtccagccttgacttactcacctacaacagtgagccaacttccctctccaaaatatatggtgtttcgtcgaccgttacttgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcgttacttgcataactctgagcgggctggcaaggc

SEQ ID NO: 680 - DNA, 495 bp, Artificial Sequence
  source: /note="Description of Artificial Sequence: Synthetic polynucleotide"
gcctccctcgcgccatcagtaggagacgcataactctcctggaactccgaccttatgatacactatcccgaaagaagtcttttacatacccaagacagagagctgggttccactgccaaaaaacagtttttcattgtcgactaggagacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggtaggagacgcataactctgagcgggctggcaaggc

SEQ ID NO: 681 - DNA, 495 bp, Artificial Sequence
  source: /note="Description of Artificial Sequence: Synthetic polynucleotide"
gcctccctcgcgccatcaggacactctgcataactagagaactctgccttcaagggacaatggccataccaccctgattctgcaacttacctaggatggagagtcgagtcccatcaccaaaatgctggggctgatgtcgacgacactctgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggacactctgcataactctgagcgggctggcaaggc

SEQ ID NO: 682 - DNA, 495 bp, Artificial Sequence
  source: /note="Description of Artificial Sequence: Synthetic polynucleotide"
gcctccctcgcgccatcagttcggaacgcataactatcattgcagtcaaacccaggcacccccgagtcaagagtggagcccccatacctgtcacagtgagcctggtcccgttcccaaagtggaggggtgaattatgtcgacttcggaacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggttcggaacgcataactctgagcgggctggcaaggc

SEQ ID NO: 683 - DNA, 495 bp, Artificial Sequence
  source: /note="Description of Artificial Sequence: Synthetic polynucleotide"
gcctccctcgcgccatcagaagtaacggcataactgggtcgtgcaggctgggctgctcaccctctctcccacctggagcccccttcttacctagcacggtgagccgtgtccctggcccgaagaactgctcattgtgtcgacaagtaacggcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggaagtaacggcataactctgagcgggctggcaaggc

SEQ ID NO: 684 - DNA, 495 bp, Artificial Sequence
  source: /note="Description of Artificial Sequence: Synthetic polynucleotide"
gcctccctcgcgccatcaggtctcctagcataactcctctgcccatcccgccctctcggagctctccggagccccaaccgcctccttacccagtacggtcagcctagagccttctccaaaaaacagctccccggtgtcgacgtctcctagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggtctcctagcataactctgagcgggctggcaaggc

SEQ ID NO: 685 - DNA, 495 bp, Artificial Sequence
  source: /note="Description of Artificial Sequence: Synthetic polynucleotide"
gcctccctcgcgccatcaggtagacacgcataactgcgtcccggggcgccccctccccagttccggggcttcagcgggagcccccgcttaccgagcactgtcagccgggtgcctgggccaaaatactgcgtatctgtcgacgtagacacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggtagacacgcataactctgagcgggctggcaaggc

SEQ ID NO: 686 - DNA, 495 bp, Artificial Sequence
  source: /note="Description of Artificial Sequence: Synthetic polynucleotide"
gcctccctcgcgccatcagcactgtacgcataactcgcacaaaaacccgagcgcagtctcgtccccggtcccccggcggccccagcttacccagcactgagagccgggtcccggcgccgaagtactgaatgttttgtcgaccactgtacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcactgtacgcataactctgagcgggctggcaaggc

SEQ ID NO: 687 - DNA, 495 bp, Artificial Sequence
  source: /note="Description of Artificial Sequence: Synthetic polynucleotide"
gcctccctcgcgccatcaggatgatccgcataactccccgcaaaaaccagacccaagccgcccgcgcccgcgccccagcagcccgcgctcaccgagcaccaggagccgcgtgcctggcccgaagtactgggtctcgtcgacgatgatccgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggatgatccgcataactctgagcgggctggcaaggc

SEQ ID NO: 688 - DNA, 495 bp, Artificial Sequence
  source: /note="Description of Artificial Sequence: Synthetic polynucleotide"
gcctccctcgcgccatcagcgccaatagcataactccgccgccttccacctgaatcccgccgcccgggtggtcccgcgaaaactcacccagcacggtcagcctgctgccggccccgaaagtcaggacgttggcccgtcgaccgccaatagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcgccaatagcataactctgagcgggctggcaaggc

SEQ ID NO: 689 - DNA, 495 bp, Artificial Sequence
  source: /note="Description of Artificial Sequence: Synthetic polynucleotide"
gcctccctcgcgccatcagtcaagcctgcataactccaccctccgactccggggaccgaggggctggaaggtggggagacgcccgaatctcacctgtgaccgtgagcctggtgcccggcccgaagtactgctcgtgtcgactcaagcctgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggtcaagcctgcataactctgagcgggctggcaaggc

SEQ ID NO: 690 - DNA, 495 bp, Artificial Sequence
  source: /note="Description of Artificial Sequence: Synthetic polynucleotide"
gcctccctcgcgccatcagagagtgtcatatgctgctgtggacccacttttccctgtgacggatctgcaaaagaacctgaaaaatgtcttacctacaactgtgagtctggtgccttgtccaaagaaagcttcagtgtcgacagagtgtcatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaaagagtgtcatatgctgctgagcgggctggcaaggc

SEQ ID NO: 691 - DNA, 495 bp, Artificial Sequence
  source: /note="Description of Artificial Sequence: Synthetic polynucleotide"
gcctccctcgcgccatcaggttccgaaatatgctgatttcccaggacagagtcctccctcatcgcacccctcctagagacccccagccttacctacaacggttaacctggtccccgaaccgaaggtgtagccatagtcgacgttccgaaatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagttccgaaatatgctgctgagcgggctggcaaggc

SEQ ID NO: 692 - DNA, 495 bp, Artificial Sequence
  source: /note="Description of Artificial Sequence: Synthetic polynucleotide"
gcctccctcgcgccatcagcgttacttatatgctgctggattccagcccctttttgcaagttcccagctgtccagccttgacttactcacctacaacagtgagccaacttccctctccaaaatatatggtgtttcgtcgaccgttacttatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacgttacttatatgctgctgagcgggctggcaaggc

SEQ ID NO: 693 - DNA, 495 bp, Artificial Sequence
  source: /note="Description of Artificial Sequence: Synthetic polynucleotide"
gcctccctcgcgccatcagtaggagacatatgctgctcctggaactccgaccttatgatacactatcccgaaagaagtcttttacatacccaagacagagagctgggttccactgccaaaaaacagtttttcattgtcgactaggagacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaataggagacatatgctgctgagcgggctggcaaggc

SEQ ID NO: 694 - DNA, 495 bp, Artificial Sequence
  source: /note="Description of Artificial Sequence: Synthetic polynucleotide"
gcctccctcgcgccatcaggacactctatatgctgagagaactctgccttcaagggacaatggccataccaccctgattctgcaacttacctaggatggagagtcgagtcccatcaccaaaatgctggggctgatgtcgacgacactctatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagacactctatatgctgctgagcgggctggcaaggc

SEQ ID NO: 695 - DNA, 495 bp, Artificial Sequence
  source: /note="Description of Artificial Sequence: Synthetic polynucleotide"
gcctccctcgcgccatcagttcggaacatatgctgatcattgcagtcaaacccaggcacccccgagtcaagagtggagcccccatacctgtcacagtgagcctggtcccgttcccaaagtggaggggtgaattatgtcgacttcggaacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaattcggaacatatgctgctgagcgggctggcaaggc

SEQ ID NO: 696 - DNA, 495 bp, Artificial Sequence
  source: /note="Description of Artificial Sequence: Synthetic polynucleotide"
gcctccctcgcgccatcagaagtaacgatatgctggggtcgtgcaggctgggctgctcaccctctctcccacctggagcccccttcttacctagcacggtgagccgtgtccctggcccgaagaactgctcattgtgtcgacaagtaacgatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaaaagtaacgatatgctgctgagcgggctggcaaggc

SEQ ID NO: 697 - DNA, 495 bp, Artificial Sequence
  source: /note="Description of Artificial Sequence: Synthetic polynucleotide"
gcctccctcgcgccatcaggtctcctaatatgctgcctctgcccatcccgccctctcggagctctccggagccccaaccgcctccttacccagtacggtcagcctagagccttctccaaaaaacagctccccggtgtcgacgtctcctaatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagtctcctaatatgctgctgagcgggctggcaaggc

SEQ ID NO: 698 - DNA, 495 bp, Artificial Sequence
  source: /note="Description of Artificial Sequence: Synthetic polynucleotide"
gcctccctcgcgccatcaggtagacacatatgctggcgtcccggggcgccccctccccagttccggggcttcagcgggagcccccgcttaccgagcactgtcagccgggtgcctgggccaaaatactgcgtatctgtcgacgtagacacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagtagacacatatgctgctgagcgggctggcaaggc

SEQ ID NO: 699 - DNA, 495 bp, Artificial Sequence
  source: /note="Description of Artificial Sequence: Synthetic polynucleotide"
gcctccctcgcgccatcagcactgtacatatgctgcgcacaaaaacccgagcgcagtctcgtccccggtcccccggcggccccagcttacccagcactgagagccgggtcccggcgccgaagtactgaatgttttgtcgaccactgtacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacactgtacatatgctgctgagcgggctggcaaggc

SEQ ID NO: 700 - DNA, 495 bp, Artificial Sequence
  source: /note="Description of Artificial Sequence: Synthetic polynucleotide"
gcctccctcgcgccatcaggatgatccatatgctgccccgcaaaaaccagacccaagccgcccgcgcccgcgccccagcagcccgcgctcaccgagcaccaggagccgcgtgcctggcccgaagtactgggtctcgtcgacgatgatccatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagatgatccatatgctgctgagcgggctggcaaggc

SEQ ID NO: 701 - DNA, 495 bp, Artificial Sequence
  source: /note="Description of Artificial Sequence: Synthetic polynucleotide"
gcctccctcgcgccatcagcgccaataatatgctgccgccgccttccacctgaatcccgccgcccgggtggtcccgcgaaaactcacccagcacggtcagcctgctgccggccccgaaagtcaggacgttggcccgtcgaccgccaataatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacgccaataatatgctgctgagcgggctggcaaggc

SEQ ID NO: 702 - DNA, 495 bp, Artificial Sequence
  source: /note="Description of Artificial Sequence: Synthetic polynucleotide"
gcctccctcgcgccatcagtcaagcctatatgctgccaccctccgactccggggaccgaggggctggaaggtggggagacgcccgaatctcacctgtgaccgtgagcctggtgcccggcccgaagtactgctcgtgtcgactcaagcctatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaatcaagcctatatgctgctgagcgggctggcaaggc

SEQ ID NO: 703 - DNA, 495 bp, Artificial Sequence
  source: /note="Description of Artificial Sequence: Synthetic polynucleotide"
gcctccctcgcgccatcagagagtgtcaatcctgcctgtggacccacttttccctgtgacggatctgcaaaagaacctgaaaaatgtcttacctacaactgtgagtctggtgccttgtccaaagaaagcttcagtgtcgacagagtgtcaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctagagtgtcaatcctgcctgagcgggctggcaaggc

SEQ ID NO: 704 - DNA, 495 bp, Artificial Sequence
  source: /note="Description of Artificial Sequence: Synthetic polynucleotide"
gcctccctcgcgccatcaggttccgaaaatcctgcatttcccaggacagagtcctccctcatcgcacccctcctagagacccccagccttacctacaacggttaacctggtccccgaaccgaaggtgtagccatagtcgacgttccgaaaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgttccgaaaatcctgcctgagcgggctggcaaggc

SEQ ID NO: 705 - DNA, 495 bp, Artificial Sequence
  source: /note="Description of Artificial Sequence: Synthetic polynucleotide"
gcctccctcgcgccatcagcgttacttaatcctgcctggattccagcccctttttgcaagttcccagctgtccagccttgacttactcacctacaacagtgagccaacttccctctccaaaatatatggtgtttcgtcgaccgttacttaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcgttacttaatcctgcctgagcgggctggcaaggc

SEQ ID NO: 706 - DNA, 495 bp, Artificial Sequence
  source: /note="Description of Artificial Sequence: Synthetic polynucleotide"
gcctccctcgcgccatcagtaggagacaatcctgcctcctggaactccgaccttatgatacactatcccgaaagaagtcttttacatacccaagacagagagctgggttccactgccaaaaaacagtttttcattgtcgactaggagacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagccttaggagacaatcctgcctgagcgggctggcaaggc

SEQ ID NO: 707 - DNA, 495 bp, Artificial Sequence
  source: /note="Description of Artificial Sequence: Synthetic polynucleotide"
gcctccctcgcgccatcaggacactctaatcctgcagagaactctgccttcaagggacaatggccataccaccctgattctgcaacttacctaggatggagagtcgagtcccatcaccaaaatgctggggctgatgtcgacgacactctaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgacactctaatcctgcctgagcgggctggcaaggc

SEQ ID NO: 708 - DNA, 495 bp, Artificial Sequence
  source: /note="Description of Artificial Sequence: Synthetic polynucleotide"
gcctccctcgcgccatcagttcggaacaatcctgcatcattgcagtcaaacccaggcacccccgagtcaagagtggagcccccatacctgtcacagtgagcctggtcccgttcccaaagtggaggggtgaattatgtcgacttcggaacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctttcggaacaatcctgcctgagcgggctggcaaggc

SEQ ID NO: 709 - DNA, 495 bp, Artificial Sequence
  source: /note="Description of Artificial Sequence: Synthetic polynucleotide"
gcctccctcgcgccatcagaagtaacgaatcctgcgggtcgtgcaggctgggctgctcaccctctctcccacctggagcccccttcttacctagcacggtgagccgtgtccctggcccgaagaactgctcattgtgtcgacaagtaacgaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctaagtaacgaatcctgcctgagcgggctggcaaggc

SEQ ID NO: 710 - DNA, 495 bp, Artificial Sequence
  source: /note="Description of Artificial Sequence: Synthetic polynucleotide"
gcctccctcgcgccatcaggtctcctaaatcctgccctctgcccatcccgccctctcggagctctccggagccccaaccgcctccttacccagtacggtcagcctagagccttctccaaaaaacagctccccggtgtcgacgtctcctaaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgtctcctaaatcctgcctgagcgggctggcaaggc

SEQ ID NO: 711 - DNA, 495 bp, Artificial Sequence
  source: /note="Description of Artificial Sequence: Synthetic polynucleotide"
gcctccctcgcgccatcaggtagacacaatcctgcgcgtcccggggcgccccctccccagttccggggcttcagcgggagcccccgcttaccgagcactgtcagccgggtgcctgggccaaaatactgcgtatctgtcgacgtagacacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgtagacacaatcctgcctgagcgggctggcaaggc

SEQ ID NO: 712 - DNA, 495 bp, Artificial Sequence
  source: /note="Description of Artificial Sequence: Synthetic polynucleotide"
gcctccctcgcgccatcagcactgtacaatcctgccgcacaaaaacccgagcgcagtctcgtccccggtcccccggcggccccagcttacccagcactgagagccgggtcccggcgccgaagtactgaatgttttgtcgaccactgtacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcactgtacaatcctgcctgagcgggctggcaaggc

SEQ ID NO: 713 - DNA, 495 bp, Artificial Sequence
  source: /note="Description of Artificial Sequence: Synthetic polynucleotide"
gcctccctcgcgccatcaggatgatccaatcctgcccccgcaaaaaccagacccaagccgcccgcgcccgcgccccagcagcccgcgctcaccgagcaccaggagccgcgtgcctggcccgaagtactgggtctcgtcgacgatgatccaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgatgatccaatcctgcctgagcgggctggcaaggc

SEQ ID NO: 714 - DNA, 495 bp, Artificial Sequence
  source: /note="Description of Artificial Sequence: Synthetic polynucleotide"
gcctccctcgcgccatcagcgccaataaatcctgcccgccgccttccacctgaatcccgccgcccgggtggtcccgcgaaaactcacccagcacggtcagcctgctgccggccccgaaagtcaggacgttggcccgtcgaccgccaataaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcgccaataaatcctgcctgagcgggctggcaaggc

SEQ ID NO: 715 - DNA, 495 bp, Artificial Sequence
  source: /note="Description of Artificial Sequence: Synthetic polynucleotide"
gcctccctcgcgccatcagtcaagcctaatcctgcccaccctccgactccggggaccgaggggctggaaggtggggagacgcccgaatctcacctgtgaccgtgagcctggtgcccggcccgaagtactgctcgtgtcgactcaagcctaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagccttcaagcctaatcctgcctgagcgggctggcaaggc

SEQ ID NO: 716 - DNA, 495 bp, Artificial Sequence
  source: /note="Description of Artificial Sequence: Synthetic polynucleotide"
gcctccctcgcgccatcagagagtgtctgagacctctgtggacccacttttccctgtgacggatctgcaaaagaacctgaaaaatgtcttacctacaactgtgagtctggtgccttgtccaaagaaagcttcagtgtcgacagagtgtctgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagagagtgtctgagacctctgagcgggctggcaaggc

SEQ ID NO: 717 - DNA, 495 bp, Artificial Sequence
  source: /note="Description of Artificial Sequence: Synthetic polynucleotide"
gcctccctcgcgccatcaggttccgaatgagacctatttcccaggacagagtcctccctcatcgcacccctcctagagacccccagccttacctacaacggttaacctggtccccgaaccgaaggtgtagccatagtcgacgttccgaatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggttccgaatgagacctctgagcgggctggcaaggc

SEQ ID NO: 718 - DNA, 495 bp, Artificial Sequence
  source: /note="Description of Artificial Sequence: Synthetic polynucleotide"
gcctccctcgcgccatcagcgttactttgagacctctggattccagcccctttttgcaagttcccagctgtccagccttgacttactcacctacaacagtgagccaacttccctctccaaaatatatggtgtttcgtcgaccgttactttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcgttactttgagacctctgagcgggctggcaaggc

SEQ ID NO: 719 - DNA, 495 bp, Artificial Sequence
  source: /note="Description of Artificial Sequence: Synthetic polynucleotide"
gcctccctcgcgccatcagtaggagactgagacctctcctggaactccgaccttatgatacactatcccgaaagaagtcttttacatacccaagacagagagctgggttccactgccaaaaaacagtttttcattgtcgactaggagactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagtaggagactgagacctctgagcgggctggcaaggc

SEQ ID NO: 720 - DNA, 495 bp, Artificial Sequence
  source: /note="Description of Artificial Sequence: Synthetic polynucleotide"
gcctccctcgcgccatcaggacactcttgagacctagagaactctgccttcaagggacaatggccataccaccctgattctgcaacttacctaggatggagagtcgagtcccatcaccaaaatgctggggctgatgtcgacgacactcttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggacactcttgagacctctgagcgggctggcaaggc

SEQ ID NO: 721 - DNA, 495 bp, Artificial Sequence
  source: /note="Description of Artificial Sequence: Synthetic polynucleotide"
gcctccctcgcgccatcagttcggaactgagacctatcattgcagtcaaacccaggcacccccgagtcaagagtggagcccccatacctgtcacagtgagcctggtcccgttcccaaagtggaggggtgaattatgtcgacttcggaactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagttcggaactgagacctctgagcgggctggcaaggc

SEQ ID NO: 722 - DNA, 495 bp, Artificial Sequence
  source: /note="Description of Artificial Sequence: Synthetic polynucleotide"
gcctccctcgcgccatcagaagtaacgtgagacctgggtcgtgcaggctgggctgctcaccctctctcccacctggagcccccttcttacctagcacggtgagccgtgtccctggcccgaagaactgctcattgtgtcgacaagtaacgtgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagaagtaacgtgagacctctgagcgggctggcaaggc

SEQ ID NO: 723 - DNA, 495 bp, Artificial Sequence
  source: /note="Description of Artificial Sequence: Synthetic polynucleotide"
gcctccctcgcgccatcaggtctcctatgagacctcctctgcccatcccgccctctcggagctctccggagccccaaccgcctccttacccagtacggtcagcctagagccttctccaaaaaacagctccccggtgtcgacgtctcctatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggtctcctatgagacctctgagcgggctggcaaggc

SEQ ID NO: 724 - DNA, 495 bp, Artificial Sequence
  source: /note="Description of Artificial Sequence: Synthetic polynucleotide"
gcctccctcgcgccatcaggtagacactgagacctgcgtcccggggcgccccctccccagttccggggcttcagcgggagcccccgcttaccgagcactgtcagccgggtgcctgggccaaaatactgcgtatctgtcgacgtagacactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggtagacactgagacctctgagcgggctggcaaggc

SEQ ID NO: 725 - DNA, 495 bp, Artificial Sequence
  source: /note="Description of Artificial Sequence: Synthetic polynucleotide"
gcctccctcgcgccatcagcactgtactgagacctcgcacaaaaacccgagcgcagtctcgtccccggtcccccggcggccccagcttacccagcactgagagccgggtcccggcgccgaagtactgaatgttttgtcgaccactgtactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcactgtactgagacctctgagcgggctggcaaggc

SEQ ID NO: 726 - DNA, 495 bp, Artificial Sequence
  source: /note="Description of Artificial Sequence: Synthetic polynucleotide"
gcctccctcgcgccatcaggatgatcctgagacctccccgcaaaaaccagacccaagccgcccgcgcccgcgccccagcagcccgcgctcaccgagcaccaggagccgcgtgcctggcccgaagtactgggtctcgtcgacgatgatcctgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggatgatcctgagacctctgagcgggctggcaaggc

SEQ ID NO: 727 - DNA, 495 bp, Artificial Sequence
  source: /note="Description of Artificial Sequence: Synthetic polynucleotide"
gcctccctcgcgccatcagcgccaatatgagacctccgccgccttccacctgaatcccgccgcccgggtggtcccgcgaaaactcacccagcacggtcagcctgctgccggccccgaaagtcaggacgttggcccgtcgaccgccaatatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcgccaatatgagacctctgagcgggctggcaaggc

SEQ ID NO: 728 - DNA, 495 bp, Artificial Sequence
  source: /note="Description of Artificial Sequence: Synthetic polynucleotide"
gcctccctcgcgccatcagtcaagccttgagacctccaccctccgactccggggaccgaggggctggaaggtggggagacgcccgaatctcacctgtgaccgtgagcctggtgcccggcccgaagtactgctcgtgtcgactcaagccttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagtcaagccttgagacctctgagcgggctggcaaggc

SEQ ID NO: 729 - DNA, 495 bp, Artificial Sequence
  source: /note="Description of Artificial Sequence: Synthetic polynucleotide"
gcctccctcgcgccatcagagagtgtcgaatggacctgtggacccacttttccctgtgacggatctgcaaaagaacctgaaaaatgtcttacctacaactgtgagtctggtgccttgtccaaagaaagcttcagtgtcgacagagtgtcgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaaagagtgtcgaatggacctgagcgggctggcaaggc

SEQ ID NO: 730 - DNA, 495 bp, Artificial Sequence
  source: /note="Description of Artificial Sequence: Synthetic polynucleotide"
gcctccctcgcgccatcaggttccgaagaatggacatttcccaggacagagtcctccctcatcgcacccctcctagagacccccagccttacctacaacggttaacctggtccccgaaccgaaggtgtagccatagtcgacgttccgaagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagttccgaagaatggacctgagcgggctggcaaggc

SEQ ID NO: 731 - DNA, 495 bp, Artificial Sequence
  source: /note="Description of Artificial Sequence: Synthetic polynucleotide"
gcctccctcgcgccatcagcgttacttgaatggacctggattccagcccctttttgcaagttcccagctgtccagccttgacttactcacctacaacagtgagccaacttccctctccaaaatatatggtgtttcgtcgaccgttacttgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacgttacttgaatggacctgagcgggctggcaaggc

SEQ ID NO: 732 - DNA, 495 bp, Artificial Sequence
  source: /note="Description of Artificial Sequence: Synthetic polynucleotide"
gcctccctcgcgccatcagtaggagacgaatggacctcctggaactccgaccttatgatacactatcccgaaagaagtcttttacatacccaagacagagagctgggttccactgccaaaaaacagtttttcattgtcgactaggagacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaataggagacgaatggacctgagcgggctggcaaggc

SEQ ID NO: 733 - DNA, 495 bp, Artificial Sequence
  source: /note="Description of Artificial Sequence: Synthetic polynucleotide"
gcctccctcgcgccatcaggacactctgaatggacagagaactctgccttcaagggacaatggccataccaccctgattctgcaacttacctaggatggagagtcgagtcccatcaccaaaatgctggggctgatgtcgacgacactctgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagacactctgaatggacctgagcgggctggcaaggc

SEQ ID NO: 734 - DNA, 495 bp, Artificial Sequence
  source: /note="Description of Artificial Sequence: Synthetic polynucleotide"
gcctccctcgcgccatcagttcggaacgaatggacatcattgcagtcaaacccaggcacccccgagtcaagagtggagcccccatacctgtcacagtgagcctggtcccgttcccaaagtggaggggtgaattatgtcgacttcggaacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaattcggaacgaatggacctgagcgggctggcaaggc

SEQ ID NO: 735 - DNA, 495 bp, Artificial Sequence
  source: /note="Description of Artificial Sequence: Synthetic polynucleotide"
gcctccctcgcgccatcagaagtaacggaatggacgggtcgtgcaggctgggctgctcaccctctctcccacctggagcccccttcttacctagcacggtgagccgtgtccctggcccgaagaactgctcattgtgtcgacaagtaacggaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaaaagtaacggaatggacctgagcgggctggcaaggc

SEQ ID NO: 736 - DNA, 495 bp, Artificial Sequence
  source: /note="Description of Artificial Sequence: Synthetic polynucleotide"
gcctccctcgcgccatcaggtctcctagaatggaccctctgcccatcccgccctctcggagctctccggagccccaaccgcctccttacccagtacggtcagcctagagccttctccaaaaaacagctccccggtgtcgacgtctcctagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagtctcctagaatggacctgagcgggctggcaaggc

SEQ ID NO: 737 - DNA, 495 bp, Artificial Sequence
  source: /note="Description of Artificial Sequence: Synthetic polynucleotide"
gcctccctcgcgccatcaggtagacacgaatggacgcgtcccggggcgccccctccccagttccggggcttcagcgggagcccccgcttaccgagcactgtcagccgggtgcctgggccaaaatactgcgtatctgtcgacgtagacacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagtagacacgaatggacctgagcgggctggcaaggc

SEQ ID NO: 738 - DNA, 495 bp, Artificial Sequence
  source: /note="Description of Artificial Sequence: Synthetic polynucleotide"
gcctccctcgcgccatcagcactgtacgaatggaccgcacaaaaacccgagcgcagtctcgtccccggtcccccggcggccccagcttacccagcactgagagccgggtcccggcgccgaagtactgaatgttttgtcgaccactgtacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacactgtacgaatggacctgagcgggctggcaaggc

SEQ ID NO: 739 - DNA, 495 bp, Artificial Sequence
  source: /note="Description of Artificial Sequence: Synthetic polynucleotide"
gcctccctcgcgccatcaggatgatccgaatggacccccgcaaaaaccagacccaagccgcccgcgcccgcgccccagcagcccgcgctcaccgagcaccaggagccgcgtgcctggcccgaagtactgggtctcgtcgacgatgatccgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagatgatccgaatggacctgagcgggctggcaaggc

SEQ ID NO: 740 - DNA, 495 bp, Artificial Sequence
  source: /note="Description of Artificial Sequence: Synthetic polynucleotide"
gcctccctcgcgccatcagcgccaatagaatggacccgccgccttccacctgaatcccgccgcccgggtggtcccgcgaaaactcacccagcacggtcagcctgctgccggccccgaaagtcaggacgttggcccgtcgaccgccaatagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacgccaatagaatggacctgagcgggctggcaaggc

SEQ ID NO: 741 - DNA, 495 bp, Artificial Sequence
  source: /note="Description of Artificial Sequence: Synthetic polynucleotide"
gcctccctcgcgccatcagtcaagcctgaatggacccaccctccgactccggggaccgaggggctggaaggtggggagacgcccgaatctcacctgtgaccgtgagcctggtgcccggcccgaagtactgctcgtgtcgactcaagcctgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaatcaagcctgaatggacctgagcgggctggcaaggc

SEQ ID NO: 742 - DNA, 495 bp, Artificial Sequence
  source: /note="Description of Artificial Sequence: Synthetic polynucleotide"
gcctccctcgcgccatcagagagtgtcgtcatagtctgtggacccacttttccctgtgacggatctgcaaaagaacctgaaaaatgtcttacctacaactgtgagtctggtgccttgtccaaagaaagcttcagtgtcgacagagtgtcgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagaagagtgtcgtcatagtctgagcgggctggcaaggc

SEQ ID NO: 743 - DNA, 495 bp, Artificial Sequence
  source: /note="Description of Artificial Sequence: Synthetic polynucleotide"
gcctccctcgcgccatcaggttccgaagtcatagtatttcccaggacagagtcctccctcatcgcacccctcctagagacccccagccttacctacaacggttaacctggtccccgaaccgaaggtgtagccatagtcgacgttccgaagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagttccgaagtcatagtctgagcgggctggcaaggc

SEQ ID NO: 744 - DNA, 495 bp, Artificial Sequence
  source: /note="Description of Artificial Sequence: Synthetic polynucleotide"
gcctccctcgcgccatcagcgttacttgtcatagtctggattccagcccctttttgcaagttcccagctgtccagccttgacttactcacctacaacagtgagccaacttccctctccaaaatatatggtgtttcgtcgaccgttacttgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacgttacttgtcatagtctgagcgggctggcaaggc

SEQ ID NO: 745 - DNA, 495 bp, Artificial Sequence
  source: /note="Description of Artificial Sequence: Synthetic polynucleotide"
gcctccctcgcgccatcagtaggagacgtcatagtctcctggaactccgaccttatgatacactatcccgaaagaagtcttttacatacccaagacagagagctgggttccactgccaaaaaacagtttttcattgtcgactaggagacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagataggagacgtcatagtctgagcgggctggcaaggc

SEQ ID NO: 746 - DNA, 495 bp, Artificial Sequence
  source: /note="Description of Artificial Sequence: Synthetic polynucleotide"
gcctccctcgcgccatcaggacactctgtcatagtagagaactctgccttcaagggacaatggccataccaccctgattctgcaacttacctaggatggagagtcgagtcccatcaccaaaatgctggggctgatgtcgacgacactctgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagacactctgtcatagtctgagcgggctggcaaggc

SEQ ID NO: 747 - DNA, 495 bp, Artificial Sequence
  source: /note="Description of Artificial Sequence: Synthetic polynucleotide"
gcctccctcgcgccatcagttcggaacgtcatagtatcattgcagtcaaacccaggcacccccgagtcaagagtggagcccccatacctgtcacagtgagcctggtcccgttcccaaagtggaggggtgaattatgtcgacttcggaacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagattcggaacgtcatagtctgagcgggctggcaaggc

SEQ ID NO: 748 - DNA, 495 bp, Artificial Sequence
  source: /note="Description of Artificial Sequence: Synthetic polynucleotide"
gcctccctcgcgccatcagaagtaacggtcatagtgggtcgtgcaggctgggctgctcaccctctctcccacctggagcccccttcttacctagcacggtgagccgtgtccctggcccgaagaactgctcattgtgtcgacaagtaacggtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagaaagtaacggtcatagtctgagcgggctggcaaggc

SEQ ID NO: 749 - DNA, 495 bp, Artificial Sequence
  source: /note="Description of Artificial Sequence: Synthetic polynucleotide"
gcctccctcgcgccatcaggtctcctagtcatagtcctctgcccatcccgccctctcggagctctccggagccccaaccgcctccttacccagtacggtcagcctagagccttctccaaaaaacagctccccggtgtcgacgtctcctagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagtctcctagtcatagtctgagcgggctggcaaggc

SEQ ID NO: 750 - DNA, 495 bp, Artificial Sequence
  source: /note="Description of Artificial Sequence: Synthetic polynucleotide"
gcctccctcgcgccatcaggtagacacgtcatagtgcgtcccggggcgccccctccccagttccggggcttcagcgggagcccccgcttaccgagcactgtcagccgggtgcctgggccaaaatactgcgtatctgtcgacgtagacacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagtagacacgtcatagtctgagcgggctggcaaggc

SEQ ID NO: 751 - DNA, 495 bp, Artificial Sequence
  source: /note="Description of Artificial Sequence: Synthetic polynucleotide"
gcctccctcgcgccatcagcactgtacgtcatagtcgcacaaaaacccgagcgcagtctcgtccccggtcccccggcggccccagcttacccagcactgagagccgggtcccggcgccgaagtactgaatgttttgtcgaccactgtacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacactgtacgtcatagtctgagcgggctggcaaggc

SEQ ID NO: 752 - DNA, 495 bp, Artificial Sequence
  source: /note="Description of Artificial Sequence: Synthetic polynucleotide"
gcctccctcgcgccatcaggatgatccgtcatagtccccgcaaaaaccagacccaagccgcccgcgcccgcgccccagcagcccgcgctcaccgagcaccaggagccgcgtgcctggcccgaagtactgggtctcgtcgacgatgatccgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagatgatccgtcatagtctgagcgggctggcaaggc

SEQ ID NO: 753 - DNA, 495 bp, Artificial Sequence
  source: /note="Description of Artificial Sequence: Synthetic polynucleotide"
gcctccctcgcgccatcagcgccaatagtcatagtccgccgccttccacctgaatcccgccgcccgggtggtcccgcgaaaactcacccagcacggtcagcctgctgccggccccgaaagtcaggacgttggcccgtcgaccgccaatagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacgccaatagtcatagtctgagcgggctggcaaggc

SEQ ID NO: 754 - DNA, 495 bp, Artificial Sequence
  source: /note="Description of Artificial Sequence: Synthetic polynucleotide"
gcctccctcgcgccatcagtcaagcctgtcatagtccaccctccgactccggggaccgaggggctggaaggtggggagacgcccgaatctcacctgtgaccgtgagcctggtgcccggcccgaagtactgctcgtgtcgactcaagcctgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagatcaagcctgtcatagtctgagcgggctggcaaggc

SEQ ID NO: 755 - DNA, 495 bp, Artificial Sequence
  source: /note="Description of Artificial Sequence: Synthetic polynucleotide"
gcctccctcgcgccatcagagagtgtccacatggactgtggacccacttttccctgtgacggatctgcaaaagaacctgaaaaatgtcttacctacaactgtgagtctggtgccttgtccaaagaaagcttcagtgtcgacagagtgtccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatagagtgtccacatggactgagcgggctggcaaggc

SEQ ID NO: 756 - DNA, 495 bp, Artificial Sequence
  source: /note="Description of Artificial Sequence: Synthetic polynucleotide"
gcctccctcgcgccatcaggttccgaacacatggaatttcccaggacagagtcctccctcatcgcacccctcctagagacccccagccttacctacaacggttaacctggtccccgaaccgaaggtgtagccatagtcgacgttccgaacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgttccgaacacatggactgagcgggctggcaaggc

SEQ ID NO: 757 - DNA, 495 bp, Artificial Sequence
  source: /note="Description of Artificial Sequence: Synthetic polynucleotide"
gcctccctcgcgccatcagcgttacttcacatggactggattccagcccctttttgcaagttcccagctgtccagccttgacttactcacctacaacagtgagccaacttccctctccaaaatatatggtgtttcgtcgaccgttacttcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcgttacttcacatggactgagcgggctggcaaggc

SEQ ID NO: 758 - DNA, 495 bp, Artificial Sequence
  source: /note="Description of Artificial Sequence: Synthetic polynucleotide"
gcctccctcgcgccatcagtaggagaccacatggactcctggaactccgaccttatgatacactatcccgaaagaagtcttttacatacccaagacagagagctgggttccactgccaaaaaacagtttttcattgtcgactaggagaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaattaggagaccacatggactgagcgggctggcaaggc

SEQ ID NO: 759 - DNA, 495 bp, Artificial Sequence
  source: /note="Description of Artificial Sequence: Synthetic polynucleotide"
gcctccctcgcgccatcaggacactctcacatggaagagaactctgccttcaagggacaatggccataccaccctgattctgcaacttacctaggatggagagtcgagtcccatcaccaaaatgctggggctgatgtcgacgacactctcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgacactctcacatggactgagcgggctggcaaggc

SEQ ID NO: 760 - DNA, 495 bp, Artificial Sequence
  source: /note="Description of Artificial Sequence: Synthetic polynucleotide"
gcctccctcgcgccatcagttcggaaccacatggaatcattgcagtcaaacccaggcacccccgagtcaagagtggagcccccatacctgtcacagtgagcctggtcccgttcccaaagtggaggggtgaattatgtcgacttcggaaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatttcggaaccacatggactgagcgggctggcaaggc

SEQ ID NO: 761 - DNA, 495 bp, Artificial Sequence
  source: /note="Description of Artificial Sequence: Synthetic polynucleotide"
gcctccctcgcgccatcagaagtaacgcacatggagggtcgtgcaggctgggctgctcaccctctctcccacctggagcccccttcttacctagcacggtgagccgtgtccctggcccgaagaactgctcattgtgtcgacaagtaacgcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaataagtaacgcacatggactgagcgggctggcaaggc

SEQ ID NO: 762 - DNA, 495 bp, Artificial Sequence
  source: /note="Description of Artificial Sequence: Synthetic polynucleotide"
gcctccctcgcgccatcaggtctcctacacatggacctctgcccatcccgccctctcggagctctccggagccccaaccgcctccttacccagtacggtcagcctagagccttctccaaaaaacagctccccggtgtcgacgtctcctacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgtctcctacacatggactgagcgggctggcaaggc

SEQ ID NO: 763 - DNA, 495 bp, Artificial Sequence
  source: /note="Description of Artificial Sequence: Synthetic polynucleotide"
gcctccctcgcgccatcaggtagacaccacatggagcgtcccggggcgccccctccccagttccggggcttcagcgggagcccccgcttaccgagcactgtcagccgggtgcctgggccaaaatactgcgtatctgtcgacgtagacaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgtagacaccacatggactgagcgggctggcaaggc

SEQ ID NO: 764 - DNA, 495 bp, Artificial Sequence
  source: /note="Description of Artificial Sequence: Synthetic polynucleotide"
gcctccctcgcgccatcagcactgtaccacatggacgcacaaaaacccgagcgcagtctcgtccccggtcccccggcggccccagcttacccagcactgagagccgggtcccggcgccgaagtactgaatgttttgtcgaccactgtaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcactgtaccacatggactgagcgggctggcaaggc

SEQ ID NO: 765 - DNA, 495 bp, Artificial Sequence
  source: /note="Description of Artificial Sequence: Synthetic polynucleotide"
gcctccctcgcgccatcaggatgatcccacatggaccccgcaaaaaccagacccaagccgcccgcgcccgcgccccagcagcccgcgctcaccgagcaccaggagccgcgtgcctggcccgaagtactgggtctcgtcgacgatgatcccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgatgatcccacatggactgagcgggctggcaaggc

SEQ ID NO: 766 - DNA, 495 bp, Artificial Sequence
  source: /note="Description of Artificial Sequence: Synthetic polynucleotide"
gcctccctcgcgccatcagcgccaatacacatggaccgccgccttccacctgaatcccgccgcccgggtggtcccgcgaaaactcacccagcacggtcagcctgctgccggccccgaaagtcaggacgttggcccgtcgaccgccaatacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcgccaatacacatggactgagcgggctggcaaggc

SEQ ID NO: 767 - DNA, 495 bp, Artificial Sequence
  source: /note="Description of Artificial Sequence: Synthetic polynucleotide"
gcctccctcgcgccatcagtcaagcctcacatggaccaccctccgactccggggaccgaggggctggaaggtggggagacgcccgaatctcacctgtgaccgtgagcctggtgcccggcccgaagtactgctcgtgtcgactcaagcctcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaattcaagcctcacatggactgagcgggctggcaaggc

SEQ ID NO: 768 - DNA, 495 bp, Artificial Sequence
  source: /note="Description of Artificial Sequence: Synthetic polynucleotide"
gcctccctcgcgccatcagagagtgtcttgaccatctgtggacccacttttccctgtgacggatctgcaaaagaacctgaaaaatgtcttacctacaactgtgagtctggtgccttgtccaaagaaagcttcagtgtcgacagagtgtcttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagaagagtgtcttgaccatctgagcgggctggcaaggc

SEQ ID NO: 769 - DNA, 495 bp, Artificial Sequence
  source: /note="Description of Artificial Sequence: Synthetic polynucleotide"
gcctccctcgcgccatcaggttccgaattgaccatatttcccaggacagagtcctccctcatcgcacccctcctagagacccccagccttacctacaacggttaacctggtccccgaaccgaaggtgtagccatagtcgacgttccgaattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagttccgaattgaccatctgagcgggctggcaaggc

SEQ ID NO: 770 - DNA, 495 bp, Artificial Sequence
  source: /note="Description of Artificial Sequence: Synthetic polynucleotide"
gcctccctcgcgccatcagcgttacttttgaccatctggattccagcccctttttgcaagttcccagctgtccagccttgacttactcacctacaacagtgagccaacttccctctccaaaatatatggtgtttcgtcgaccgttacttttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacgttacttttgaccatctgagcgggctggcaaggc

SEQ ID NO: 771 - DNA, 495 bp, Artificial Sequence
  source: /note="Description of Artificial Sequence: Synthetic polynucleotide"
gcctccctcgcgccatcagtaggagacttgaccatctcctggaactccgaccttatgatacactatcccgaaagaagtcttttacatacccaagacagagagctgggttccactgccaaaaaacagtttttcattgtcgactaggagacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagataggagacttgaccatctgagcgggctggcaaggc

SEQ ID NO: 772 - DNA, 495 bp, Artificial Sequence
  source: /note="Description of Artificial Sequence: Synthetic polynucleotide"
gcctccctcgcgccatcaggacactctttgaccatagagaactctgccttcaagggacaatggccataccaccctgattctgcaacttacctaggatggagagtcgagtcccatcaccaaaatgctggggctgatgtcgacgacactctttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagacactctttgaccatctgagcgggctggcaaggc

SEQ ID NO: 773 - DNA, 495 bp, Artificial Sequence
  source: /note="Description of Artificial Sequence: Synthetic polynucleotide"
gcctccctcgcgccatcagttcggaacttgaccatatcattgcagtcaaacccaggcacccccgagtcaagagtggagcccccatacctgtcacagtgagcctggtcccgttcccaaagtggaggggtgaattatgtcgacttcggaacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagattcggaacttgaccatctgagcgggctggcaaggc

SEQ ID NO: 774 - DNA, 495 bp, Artificial Sequence
  source: /note="Description of Artificial Sequence: Synthetic polynucleotide"
gcctccctcgcgccatcagaagtaacgttgaccatgggtcgtgcaggctgggctgctcaccctctctcccacctggagcccccttcttacctagcacggtgagccgtgtccctggcccgaagaactgctcattgtgtcgacaagtaacgttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagaaagtaacgttgaccatctgagcgggctggcaaggc

SEQ ID NO: 775 - DNA, 495 bp, Artificial Sequence
  source: /note="Description of Artificial Sequence: Synthetic polynucleotide"
gcctccctcgcgccatcaggtctcctattgaccatcctctgcccatcccgccctctcggagctctccggagccccaaccgcctccttacccagtacggtcagcctagagccttctccaaaaaacagctccccggtgtcgacgtctcctattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagtctcctattgaccatctgagcgggctggcaaggc

SEQ ID NO: 776 - DNA, 495 bp, Artificial Sequence
  source: /note="Description of Artificial Sequence: Synthetic polynucleotide"
gcctccctcgcgccatcaggtagacacttgaccatgcgtcccggggcgccccctccccagttccggggcttcagcgggagcccccgcttaccgagcactgtcagccgggtgcctgggccaaaatactgcgtatctgtcgacgtagacacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagtagacacttgaccatctgagcgggctggcaaggc

SEQ ID NO: 777 - DNA, 495 bp, Artificial Sequence
  source: /note="Description of Artificial Sequence: Synthetic polynucleotide"
gcctccctcgcgccatcagcactgtacttgaccatcgcacaaaaacccgagcgcagtctcgtccccggtcccccggcggccccagcttacccagcactgagagccgggtcccggcgccgaagtactgaatgttttgtcgaccactgtacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacactgtacttgaccatctgagcgggctggcaaggc

SEQ ID NO: 778 - DNA, 495 bp, Artificial Sequence
  source: /note="Description of Artificial Sequence: Synthetic polynucleotide"
gcctccctcgcgccatcaggatgatccttgaccatccccgcaaaaaccagacccaagccgcccgcgcccgcgccccagcagcccgcgctcaccgagcaccaggagccgcgtgcctggcccgaagtactgggtctcgtcgacgatgatccttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagatgatccttgaccatctgagcgggctggcaaggc

SEQ ID NO: 779 - DNA, 495 bp, Artificial Sequence
  source: /note="Description of Artificial Sequence: Synthetic polynucleotide"
gcctccctcgcgccatcagcgccaatattgaccatccgccgccttccacctgaatcccgccgcccgggtggtcccgcgaaaactcacccagcacggtcagcctgctgccggccccgaaagtcaggacgttggcccgtcgaccgccaatattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacgccaatattgaccatctgagcgggctggcaaggc

SEQ ID NO: 780 - DNA, 495 bp, Artificial Sequence
  source: /note="Description of Artificial Sequence: Synthetic polynucleotide"
gcctccctcgcgccatcagtcaagcctttgaccatccaccctccgactccggggaccgaggggctggaaggtggggagacgcccgaatctcacctgtgaccgtgagcctggtgcccggcccgaagtactgctcgtgtcgactcaagcctttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagatcaagcctttgaccatctgagcgggctggcaaggc

SEQ ID NO: 781 - DNA, 495 bp, Artificial Sequence
  source: /note="Description of Artificial Sequence: Synthetic polynucleotide"
gcctccctcgcgccatcagagagtgtcgtgacttgctgtggacccacttttccctgtgacggatctgcaaaagaacctgaaaaatgtcttacctacaactgtgagtctggtgccttgtccaaagaaagcttcagtgtcgacagagtgtcgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggagagtgtcgtgacttgctgagcgggctggcaaggc

SEQ ID NO: 782 - DNA, 495 bp, Artificial Sequence
  source: /note="Description of Artificial Sequence: Synthetic polynucleotide"
gcctccctcgcgccatcaggttccgaagtgacttgatttcccaggacagagtcctccctcatcgcacccctcctagagacccccagccttacctacaacggttaacctggtccccgaaccgaaggtgtagccatagtcgacgttccgaagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggttccgaagtgacttgctgagcgggctggcaaggc

SEQ ID NO: 783 - DNA, 495 bp, Artificial Sequence
  source: /note="Description of Artificial Sequence: Synthetic polynucleotide"
gcctccctcgcgccatcagcgttacttgtgacttgctggattccagcccctttttgcaagttcccagctgtccagccttgacttactcacctacaacagtgagccaacttccctctccaaaatatatggtgtttcgtcgaccgttacttgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcgttacttgtgacttgctgagcgggctggcaaggc

SEQ ID NO: 784 - DNA, 495 bp, Artificial Sequence
  source: /note="Description of Artificial Sequence: Synthetic polynucleotide"
gcctccctcgcgccatcagtaggagacgtgacttgctcctggaactccgaccttatgatacactatcccgaaagaagtcttttacatacccaagacagagagctgggttccactgccaaaaaacagtttttcattgtcgactaggagacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggtaggagacgtgacttgctgagcgggctggcaaggc

SEQ ID NO: 785 - DNA, 495 bp, Artificial Sequence
  source: /note="Description of Artificial Sequence: Synthetic polynucleotide"
gcctccctcgcgccatcaggacactctgtgacttgagagaactctgccttcaagggacaatggccataccaccctgattctgcaacttacctaggatggagagtcgagtcccatcaccaaaatgctggggctgatgtcgacgacactctgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggacactctgtgacttgctgagcgggctggcaaggc

SEQ ID NO: 786 - DNA, 495 bp, Artificial Sequence
  source: /note="Description of Artificial Sequence: Synthetic polynucleotide"
gcctccctcgcgccatcagttcggaacgtgacttgatcattgcagtcaaacccaggcacccccgagtcaagagtggagcccccatacctgtcacagtgagcctggtcccgttcccaaagtggaggggtgaattatgtcgacttcggaacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggttcggaacgtgacttgctgagcgggctggcaaggc

SEQ ID NO: 787 - DNA, 495 bp, Artificial Sequence
  source: /note="Description of Artificial Sequence: Synthetic polynucleotide"
gcctccctcgcgccatcagaagtaacggtgacttggggtcgtgcaggctgggctgctcaccctctctcccacctggagcccccttcttacctagcacggtgagccgtgtccctggcccgaagaactgctcattgtgtcgacaagtaacggtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggaagtaacggtgacttgctgagcgggctggcaaggc

SEQ ID NO: 788 - DNA, 495 bp, Artificial Sequence
  source: /note="Description of Artificial Sequence: Synthetic polynucleotide"
gcctccctcgcgccatcaggtctcctagtgacttgcctctgcccatcccgccctctcggagctctccggagccccaaccgcctccttacccagtacggtcagcctagagccttctccaaaaaacagctccccggtgtcgacgtctcctagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggtctcctagtgacttgctgagcgggctggcaaggc

SEQ ID NO: 789 - DNA, 495 bp, Artificial Sequence
  source: /note="Description of Artificial Sequence: Synthetic polynucleotide"
gcctccctcgcgccatcaggtagacacgtgacttggcgtcccggggcgccccctccccagttccggggcttcagcgggagcccccgcttaccgagcactgtcagccgggtgcctgggccaaaatactgcgtatctgtcgacgtagacacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggtagacacgtgacttgctgagcgggctggcaaggc

SEQ ID NO: 790 - DNA, 495 bp, Artificial Sequence
  source: /note="Description of Artificial Sequence: Synthetic polynucleotide"
gcctccctcgcgccatcagcactgtacgtgacttgcgcacaaaaacccgagcgcagtctcgtccccggtcccccggcggccccagcttacccagcactgagagccgggtcccggcgccgaagtactgaatgttttgtcgaccactgtacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcactgtacgtgacttgctgagcgggctggcaaggc

SEQ ID NO: 791 - DNA, 495 bp, Artificial Sequence
  source: /note="Description of Artificial Sequence: Synthetic polynucleotide"
gcctccctcgcgccatcaggatgatccgtgacttgccccgcaaaaaccagacccaagccgcccgcgcccgcgccccagcagcccgcgctcaccgagcaccaggagccgcgtgcctggcccgaagtactgggtctcgtcgacgatgatccgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggatgatccgtgacttgctgagcgggctggcaaggc

SEQ ID NO: 792 - DNA, 495 bp, Artificial Sequence
  source: /note="Description of Artificial Sequence: Synthetic polynucleotide"
gcctccctcgcgccatcagcgccaatagtgacttgccgccgccttccacctgaatcccgccgcccgggtggtcccgcgaaaactcacccagcacggtcagcctgctgccggccccgaaagtcaggacgttggcccgtcgaccgccaatagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcgccaatagtgacttgctgagcgggctggcaaggc

SEQ ID NO: 793 - DNA, 495 bp, Artificial Sequence
  source: /note="Description of Artificial Sequence: Synthetic polynucleotide"
gcctccctcgcgccatcagtcaagcctgtgacttgccaccctccgactccggggaccgaggggctggaaggtggggagacgcccgaatctcacctgtgaccgtgagcctggtgcccggcccgaagtactgctcgtgtcgactcaagcctgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggtcaagcctgtgacttgctgagcgggctggcaaggc

SEQ ID NO: 794 - DNA, 495 bp, Artificial Sequence
  source: /note="Description of Artificial Sequence: Synthetic polynucleotide"
gcctccctcgcgccatcagagagtgtcaagccatcctgtggacccacttttccctgtgacggatctgcaaaagaacctgaaaaatgtcttacctacaactgtgagtctggtgccttgtccaaagaaagcttcagtgtcgacagagtgtcaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaaagagtgtcaagccatcctgagcgggctggcaaggc

SEQ ID NO: 795 - DNA, 495 bp, Artificial Sequence
  source: /note="Description of Artificial Sequence: Synthetic polynucleotide"
gcctccctcgcgccatcaggttccgaaaagccatcatttcccaggacagagtcctccctcatcgcacccctcctagagacccccagccttacctacaacggttaacctggtccccgaaccgaaggtgtagccatagtcgacgttccgaaaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagttccgaaaagccatcctgagcgggctggcaaggc

SEQ ID NO: 796 - DNA, 495 bp, Artificial Sequence
  source: /note="Description of Artificial Sequence: Synthetic polynucleotide"
gcctccctcgcgccatcagcgttacttaagccatcctggattccagcccctttttgcaagttcccagctgtccagccttgacttactcacctacaacagtgagccaacttccctctccaaaatatatggtgtttcgtcgaccgttacttaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacgttacttaagccatcctgagcgggctggcaaggc

SEQ ID NO: 797 - DNA, 495 bp, Artificial Sequence
  source: /note="Description of Artificial Sequence: Synthetic polynucleotide"
gcctccctcgcgccatcagtaggagacaagccatcctcctggaactccgaccttatgatacactatcccgaaagaagtcttttacatacccaagacagagagctgggttccactgccaaaaaacagtttttcattgtcgactaggagacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaataggagacaagccatcctgagcgggctggcaaggc

SEQ ID NO: 798 - DNA, 495 bp, Artificial Sequence
  source: /note="Description of Artificial Sequence: Synthetic polynucleotide"
gcctccctcgcgccatcaggacactctaagccatcagagaactctgccttcaagggacaatggccataccaccctgattctgcaacttacctaggatggagagtcgagtcccatcaccaaaatgctggggctgatgtcgacgacactctaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagacactctaagccatcctgagcgggctggcaaggc

SEQ ID NO: 799 - DNA, 495 bp, Artificial Sequence
  source: /note="Description of Artificial Sequence: Synthetic polynucleotide"
gcctccctcgcgccatcagttcggaacaagccatcatcattgcagtcaaacccaggcacccccgagtcaagagtggagcccccatacctgtcacagtgagcctggtcccgttcccaaagtggaggggtgaattatgtcgacttcggaacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaattcggaacaagccatcctgagcgggctggcaaggc

SEQ ID NO: 800 - DNA, 495 bp, Artificial Sequence
  source: /note="Description of Artificial Sequence: Synthetic polynucleotide"
gcctccctcgcgccatcagaagtaacgaagccatcgggtcgtgcaggctgggctgctcaccctctctcccacctggagcccccttcttacctagcacggtgagccgtgtccctggcccgaagaactgctcattgtgtcgacaagtaacgaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaaaagtaacgaagccatcctgagcgggctggcaaggc

SEQ ID NO: 801 - DNA, 495 bp, Artificial Sequence
  source: /note="Description of Artificial Sequence: Synthetic polynucleotide"
gcctccctcgcgccatcaggtctcctaaagccatccctctgcccatcccgccctctcggagctctccggagccccaaccgcctccttacccagtacggtcagcctagagccttctccaaaaaacagctccccggtgtcgacgtctcctaaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagtctcctaaagccatcctgagcgggctggcaaggc

SEQ ID NO: 802 - DNA, 495 bp, Artificial Sequence
  source: /note="Description of Artificial Sequence: Synthetic polynucleotide"
gcctccctcgcgccatcaggtagacacaagccatcgcgtcccggggcgccccctccccagttccggggcttcagcgggagcccccgcttaccgagcactgtcagccgggtgcctgggccaaaatactgcgtatctgtcgacgtagacacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagtagacacaagccatcctgagcgggctggcaaggc

SEQ ID NO: 803 - DNA, 495 bp, Artificial Sequence
  source: /note="Description of Artificial Sequence: Synthetic polynucleotide"
gcctccctcgcgccatcagcactgtacaagccatccgcacaaaaacccgagcgcagtctcgtccccggtcccccggcggccccagcttacccagcactgagagccgggtcccggcgccgaagtactgaatgttttgtcgaccactgtacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacactgtacaagccatcctgagcgggctggcaaggc

SEQ ID NO: 804 - DNA, 495 bp, Artificial Sequence
  source: /note="Description of Artificial Sequence: Synthetic polynucleotide"
gcctccctcgcgccatcaggatgatccaagccatcccccgcaaaaaccagacccaagccgcccgcgcccgcgccccagcagcccgcgctcaccgagcaccaggagccgcgtgcctggcccgaagtactgggtctcgtcgacgatgatccaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagatgatccaagccatcctgagcgggctggcaaggc

SEQ ID NO: 805 - DNA, 495 bp, Artificial Sequence
  source: /note="Description of Artificial Sequence: Synthetic polynucleotide"
gcctccctcgcgccatcagcgccaataaagccatcccgccgccttccacctgaatcccgccgcccgggtggtcccgcgaaaactcacccagcacggtcagcctgctgccggccccgaaagtcaggacgttggcccgtcgaccgccaataaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacgccaataaagccatcctgagcgggctggcaaggc

SEQ ID NO: 806 - DNA, 495 bp, Artificial Sequence
  source: /note="Description of Artificial Sequence: Synthetic polynucleotide"
gcctccctcgcgccatcagtcaagcctaagccatcccaccctccgactccggggaccgaggggctggaaggtggggagacgcccgaatctcacctgtgaccgtgagcctggtgcccggcccgaagtactgctcgtgtcgactcaagcctaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaatcaagcctaagccatcctgagcgggctggcaaggc

SEQ ID NO: 807 - DNA, 495 bp, Artificial Sequence
  source: /note="Description of Artificial Sequence: Synthetic polynucleotide"
gcctccctcgcgccatcagagagtgtcgattgcagctgtggacccacttttccctgtgacggatctgcaaaagaacctgaaaaatgtcttacctacaactgtgagtctggtgccttgtccaaagaaagcttcagtgtcgacagagtgtcgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacagagtgtcgattgcagctgagcgggctggcaaggc

SEQ ID NO: 808 - DNA, 495 bp, Artificial Sequence
  source: /note="Description of Artificial Sequence: Synthetic polynucleotide"
gcctccctcgcgccatcaggttccgaagattgcagatttcccaggacagagtcctccctcatcgcacccctcctagagacccccagccttacctacaacggttaacctggtccccgaaccgaaggtgtagccatagtcgacgttccgaagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgttccgaagattgcagctgagcgggctggcaaggc

SEQ ID NO: 809 - DNA, 495 bp, Artificial Sequence
  source: /note="Description of Artificial Sequence: Synthetic polynucleotide"
gcctccctcgcgccatcagcgttacttgattgcagctggattccagcccctttttgcaagttcccagctgtccagccttgacttactcacctacaacagtgagccaacttccctctccaaaatatatggtgtttcgtcgaccgttacttgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccgttacttgattgcagctgagcgggctggcaaggc

SEQ ID NO: 810 - DNA, 495 bp, Artificial Sequence
  source: /note="Description of Artificial Sequence: Synthetic polynucleotide"
gcctccctcgcgccatcagtaggagacgattgcagctcctggaactccgaccttatgatacactatcccgaaagaagtcttttacatacccaagacagagagctgggttccactgccaaaaaacagtttttcattgtcgactaggagacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagactaggagacgattgcagctgagcgggctggcaaggc

SEQ ID NO: 811 - DNA, 495 bp, Artificial Sequence
  source: /note="Description of Artificial Sequence: Synthetic polynucleotide"
gcctccctcgcgccatcaggacactctgattgcagagagaactctgccttcaagggacaatggccataccaccctgattctgcaacttacctaggatggagagtcgagtcccatcaccaaaatgctggggctgatgtcgacgacactctgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgacactctgattgcagctgagcgggctggcaaggc

SEQ ID NO: 812 - DNA, 495 bp, Artificial Sequence
  source: /note="Description of Artificial Sequence: Synthetic polynucleotide"
gcctccctcgcgccatcagttcggaacgattgcagatcattgcagtcaaacccaggcacccccgagtcaagagtggagcccccatacctgtcacagtgagcctggtcccgttcccaaagtggaggggtgaattatgtcgacttcggaacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacttcggaacgattgcagctgagcgggctggcaaggc

SEQ ID NO: 813 - DNA, 495 bp, Artificial Sequence
  source: /note="Description of Artificial Sequence: Synthetic polynucleotide"
gcctccctcgcgccatcagaagtaacggattgcaggggtcgtgcaggctgggctgctcaccctctctcccacctggagcccccttcttacctagcacggtgagccgtgtccctggcccgaagaactgctcattgtgtcgacaagtaacggattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacaagtaacggattgcagctgagcgggctggcaaggc

SEQ ID NO: 814 - DNA, 495 bp, Artificial Sequence
  source: /note="Description of Artificial Sequence: Synthetic polynucleotide"
gcctccctcgcgccatcaggtctcctagattgcagcctctgcccatcccgccctctcggagctctccggagccccaaccgcctccttacccagtacggtcagcctagagccttctccaaaaaacagctccccggtgtcgacgtctcctagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgtctcctagattgcagctgagcgggctggcaaggc

SEQ ID NO: 815 - DNA, 495 bp, Artificial Sequence
  source: /note="Description of Artificial Sequence: Synthetic polynucleotide"
gcctccctcgcgccatcaggtagacacgattgcaggcgtcccggggcgccccctccccagttccggggcttcagcgggagcccccgcttaccgagcactgtcagccgggtgcctgggccaaaatactgcgtatctgtcgacgtagacacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgtagacacgattgcagctgagcgggctggcaaggc

SEQ ID NO: 816 - DNA, 495 bp, Artificial Sequence
  source: /note="Description of Artificial Sequence: Synthetic polynucleotide"
gcctccctcgcgccatcagcactgtacgattgcagcgcacaaaaacccgagcgcagtctcgtccccggtcccccggcggccccagcttacccagcactgagagccgggtcccggcgccgaagtactgaatgttttgtcgaccactgtacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccactgtacgattgcagctgagcgggctggcaaggc

SEQ ID NO: 817 - DNA, 495 bp, Artificial Sequence
  source: /note="Description of Artificial Sequence: Synthetic polynucleotide"
gcctccctcgcgccatcaggatgatccgattgcagccccgcaaaaaccagacccaagccgcccgcgcccgcgccccagcagcccgcgctcaccgagcaccaggagccgcgtgcctggcccgaagtactgggtctcgtcgacgatgatccgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgatgatccgattgcagctgagcgggctggcaaggc

SEQ ID NO: 818 - DNA, 495 bp, Artificial Sequence
  source: /note="Description of Artificial Sequence: Synthetic polynucleotide"
gcctccctcgcgccatcagcgccaatagattgcagccgccgccttccacctgaatcccgccgcccgggtggtcccgcgaaaactcacccagcacggtcagcctgctgccggccccgaaagtcaggacgttggcccgtcgaccgccaatagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccgccaatagattgcagctgagcgggctggcaaggc

SEQ ID NO: 819 - DNA, 495 bp, Artificial Sequence
  source: /note="Description of Artificial Sequence: Synthetic polynucleotide"
gcctccctcgcgccatcagtcaagcctgattgcagccaccctccgactccggggaccgaggggctggaaggtggggagacgcccgaatctcacctgtgaccgtgagcctggtgcccggcccgaagtactgctcgtgtcgactcaagcctgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagactcaagcctgattgcagctgagcgggctggcaaggc

SEQ ID NO: 820 - DNA, 495 bp, Artificial Sequence
  source: /note="Description of Artificial Sequence: Synthetic polynucleotide"
gcctccctcgcgccatcagagagtgtcactatgacctgtggacccacttttccctgtgacggatctgcaaaagaacctgaaaaatgtcttacctacaactgtgagtctggtgccttgtccaaagaaagcttcagtgtcgacagagtgtcactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtagagtgtcactatgacctgagcgggctggcaaggc

SEQ ID NO: 821 - DNA, 495 bp, Artificial Sequence
  source: /note="Description of Artificial Sequence: Synthetic polynucleotide"
gcctccctcgcgccatcaggttccgaaactatgacatttcccaggacagagtcctccctcatcgcacccctcctagagacccccagccttacctacaacggttaacctggtccccgaaccgaaggtgtagccatagtcgacgttccgaaactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgttccgaaactatgacctgagcgggctggcaaggc

SEQ ID NO: 822 - DNA, 495 bp, Artificial Sequence
  source: /note="Description of Artificial Sequence: Synthetic polynucleotide"
gcctccctcgcgccatcagcgttacttactatgacctggattccagcccctttttgcaagttcccagctgtccagccttgacttactcacctacaacagtgagccaacttccctctccaaaatatatggtgtttcgtcgaccgttacttactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcgttacttactatgacctgagcgggctggcaaggc

SEQ ID NO: 823 - DNA, 495 bp, Artificial Sequence
  source: /note="Description of Artificial Sequence: Synthetic polynucleotide"
gcctccctcgcgccatcagtaggagacactatgacctcctggaactccgaccttatgatacactatcccgaaagaagtcttttacatacccaagacagagagctgggttccactgccaaaaaacagtttttcattgtcgactaggagacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagttaggagacactatgacctgagcgggctggcaaggc

SEQ ID NO: 824 - DNA, 495 bp, Artificial Sequence
  source: /note="Description of Artificial Sequence: Synthetic polynucleotide"
gcctccctcgcgccatcaggacactctactatgacagagaactctgccttcaagggacaatggccataccaccctgattctgcaacttacctaggatggagagtcgagtcccatcaccaaaatgctggggctgatgtcgacgacactctactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgacactctactatgacctgagcgggctggcaaggc

SEQ ID NO: 825 - DNA, 495 bp, Artificial Sequence
  source: /note="Description of Artificial Sequence: Synthetic polynucleotide"
gcctccctcgcgccatcagttcggaacactatgacatcattgcagtcaaacccaggcacccccgagtcaagagtggagcccccatacctgtcacagtgagcctggtcccgttcccaaagtggaggggtgaattatgtcgacttcggaacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtttcggaacactatgacctgagcgggctggcaaggc

SEQ ID NO: 826 - DNA, 495 bp, Artificial Sequence
  source: /note="Description of Artificial Sequence: Synthetic polynucleotide"
gcctccctcgcgccatcagaagtaacgactatgacgggtcgtgcaggctgggctgctcaccctctctcccacctggagcccccttcttacctagcacggtgagccgtgtccctggcccgaagaactgctcattgtgtcgacaagtaacgactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtaagtaacgactatgacctgagcgggctggcaaggc

SEQ ID NO: 827 - DNA, 495 bp, Artificial Sequence
  source: /note="Description of Artificial Sequence: Synthetic polynucleotide"
gcctccctcgcgccatcaggtctcctaactatgaccctctgcccatcccgccctctcggagctctccggagccccaaccgcctccttacccagtacggtcagcctagagccttctccaaaaaacagctccccggtgtcgacgtctcctaactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgtctcctaactatgacctgagcgggctggcaaggc

SEQ ID NO: 828 - DNA, 495 bp, Artificial Sequence
  source: /note="Description of Artificial Sequence: Synthetic polynucleotide"
gcctccctcgcgccatcaggtagacacactatgacgcgtcccggggcgccccctccccagttccggggcttcagcgggagcccccgcttaccgagcactgtcagccgggtgcctgggccaaaatactgcgtatctgtcgacgtagacacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgtagacacactatgacctgagcgggctggcaaggc

SEQ ID NO: 829 - DNA, 495 bp, Artificial Sequence
  source: /note="Description of Artificial Sequence: Synthetic polynucleotide"
gcctccctcgcgccatcagcactgtacactatgaccgcacaaaaacccgagcgcagtctcgtccccggtcccccggcggccccagcttacccagcactgagagccgggtcccggcgccgaagtactgaatgttttgtcgaccactgtacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcactgtacactatgacctgagcgggctggcaaggc

SEQ ID NO: 830 - DNA, 495 bp, Artificial Sequence
  source: /note="Description of Artificial Sequence: Synthetic polynucleotide"
gcctccctcgcgccatcaggatgatccactatgacccccgcaaaaaccagacccaagccgcccgcgcccgcgccccagcagcccgcgctcaccgagcaccaggagccgcgtgcctggcccgaagtactgggtctcgtcgacgatgatccactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgatgatccactatgacctgagcgggctggcaaggc

SEQ ID NO: 831 - DNA, 495 bp, Artificial Sequence
  source: /note="Description of Artificial Sequence: Synthetic polynucleotide"
gcctccctcgcgccatcagcgccaataactatgacccgccgccttccacctgaatcccgccgcccgggtggtcccgcgaaaactcacccagcacggtcagcctgctgccggccccgaaagtcaggacgttggcccgtcgaccgccaataactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcgccaataactatgacctgagcgggctggcaaggc

SEQ ID NO: 832 - DNA, 495 bp, Artificial Sequence
  source: /note="Description of Artificial Sequence: Synthetic polynucleotide"
gcctccctcgcgccatcagtcaagcctactatgacccaccctccgactccggggaccgaggggctggaaggtggggagacgcccgaatctcacctgtgaccgtgagcctggtgcccggcccgaagtactgctcgtgtcgactcaagcctactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagttcaagcctactatgacctgagcgggctggcaaggc

SEQ ID NO: 833 - DNA, 495 bp, Artificial Sequence
  source: /note="Description of Artificial Sequence: Synthetic polynucleotide"
gcctccctcgcgccatcagagagtgtctccatgtgctgtggacccacttttccctgtgacggatctgcaaaagaacctgaaaaatgtcttacctacaactgtgagtctggtgccttgtccaaagaaagcttcagtgtcgacagagtgtctccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataagagtgtctccatgtgctgagcgggctggcaaggc

SEQ ID NO: 834 - DNA, 495 bp, Artificial Sequence
  source: /note="Description of Artificial Sequence: Synthetic polynucleotide"
gcctccctcgcgccatcaggttccgaatccatgtgatttcccaggacagagtcctccctcatcgcacccctcctagagacccccagccttacctacaacggttaacctggtccccgaaccgaaggtgtagccatagtcgacgttccgaatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagttccgaatccatgtgctgagcgggctggcaaggc

SEQ ID NO: 835 - DNA, 495 bp, Artificial Sequence
  source: /note="Description of Artificial Sequence: Synthetic polynucleotide"
gcctccctcgcgccatcagcgttactttccatgtgctggattccagcccctttttgcaagttcccagctgtccagccttgacttactcacctacaacagtgagccaacttccctctccaaaatatatggtgtttcgtcgaccgttactttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacgttactttccatgtgctgagcgggctggcaaggc

SEQ ID NO: 836 - DNA, 495 bp, Artificial Sequence
  source: /note="Description of Artificial Sequence: Synthetic polynucleotide"
gcctccctcgcgccatcagtaggagactccatgtgctcctggaactccgaccttatgatacactatcccgaaagaagtcttttacatacccaagacagagagctgggttccactgccaaaaaacagtttttcattgtcgactaggagactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatataggagactccatgtgctgagcgggctggcaaggc

SEQ ID NO: 837 - DNA, 495 bp, Artificial Sequence
  source: /note="Description of Artificial Sequence: Synthetic polynucleotide"
gcctccctcgcgccatcaggacactcttccatgtgagagaactctgccttcaagggacaatggccataccaccctgattctgcaacttacctaggatggagagtcgagtcccatcaccaaaatgctggggctgatgtcgacgacactcttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagacactcttccatgtgctgagcgggctggcaaggc

SEQ ID NO: 838 - DNA, 495 bp, Artificial Sequence
  source: /note="Description of Artificial Sequence: Synthetic polynucleotide"
gcctccctcgcgccatcagttcggaactccatgtgatcattgcagtcaaacccaggcacccccgagtcaagagtggagcccccatacctgtcacagtgagcctggtcccgttcccaaagtggaggggtgaattatgtcgacttcggaactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatattcggaactccatgtgctgagcgggctggcaaggc

SEQ ID NO: 839 - DNA, 495 bp, Artificial Sequence
  source: /note="Description of Artificial Sequence: Synthetic polynucleotide"
gcctccctcgcgccatcagaagtaacgtccatgtggggtcgtgcaggctgggctgctcaccctctctcccacctggagcccccttcttacctagcacggtgagccgtgtccctggcccgaagaactgctcattgtgtcgacaagtaacgtccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataaagtaacgtccatgtgctgagcgggctggcaaggc

SEQ ID NO: 840 - DNA, 495 bp, Artificial Sequence
  source: /note="Description of Artificial Sequence: Synthetic polynucleotide"
gcctccctcgcgccatcaggtctcctatccatgtgcctctgcccatcccgccctctcggagctctccggagccccaaccgcctccttacccagtacggtcagcctagagccttctccaaaaaacagctccccggtgtcgacgtctcctatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagtctcctatccatgtgctgagcgggctggcaaggc

SEQ ID NO: 841 - DNA, 495 bp, Artificial Sequence
  source: /note="Description of Artificial Sequence: Synthetic polynucleotide"
gcctccctcgcgccatcaggtagacactccatgtggcgtcccggggcgccccctccccagttccggggcttcagcgggagcccccgcttaccgagcactgtcagccgggtgcctgggccaaaatactgcgtatctgtcgacgtagacactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagtagacactccatgtgctgagcgggctggcaaggc

SEQ ID NO: 842 - DNA, 495 bp, Artificial Sequence
  source: /note="Description of Artificial Sequence: Synthetic polynucleotide"
gcctccctcgcgccatcagcactgtactccatgtgcgcacaaaaacccgagcgcagtctcgtccccggtcccccggcggccccagcttacccagcactgagagccgggtcccggcgccgaagtactgaatgttttgtcgaccactgtactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacactgtactccatgtgctgagcgggctggcaaggc

SEQ ID NO: 843 - DNA, 495 bp, Artificial Sequence
  source: /note="Description of Artificial Sequence: Synthetic polynucleotide"
gcctccctcgcgccatcaggatgatcctccatgtgccccgcaaaaaccagacccaagccgcccgcgcccgcgccccagcagcccgcgctcaccgagcaccaggagccgcgtgcctggcccgaagtactgggtctcgtcgacgatgatcctccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagatgatcctccatgtgctgagcgggctggcaaggc

SEQ ID NO: 844 - DNA, 495 bp, Artificial Sequence
  source: /note="Description of Artificial Sequence: Synthetic polynucleotide"
gcctccctcgcgccatcagcgccaatatccatgtgccgccgccttccacctgaatcccgccgcccgggtggtcccgcgaaaactcacccagcacggtcagcctgctgccggccccgaaagtcaggacgttggcccgtcgaccgccaatatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacgccaatatccatgtgctgagcgggctggcaaggc

SEQ ID NO: 845 - DNA, 495 bp, Artificial Sequence
  source: /note="Description of Artificial Sequence: Synthetic polynucleotide"
gcctccctcgcgccatcagtcaagccttccatgtgccaccctccgactccggggaccgaggggctggaaggtggggagacgcccgaatctcacctgtgaccgtgagcctggtgcccggcccgaagtactgctcgtgtcgactcaagccttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatatcaagccttccatgtgctgagcgggctggcaaggc

SEQ ID NO: 846 - DNA, 495 bp, Artificial Sequence
  source: /note="Description of Artificial Sequence: Synthetic polynucleotide"
gcctccctcgcgccatcagagagtgtcatggtcaactgtggacccacttttccctgtgacggatctgcaaaagaacctgaaaaatgtcttacctacaactgtgagtctggtgccttgtccaaagaaagcttcagtgtcgacagagtgtcatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagaagagtgtcatggtcaactgagcgggctggcaaggc

SEQ ID NO: 847 - DNA, 495 bp, Artificial Sequence
  source: /note="Description of Artificial Sequence: Synthetic polynucleotide"
gcctccctcgcgccatcaggttccgaaatggtcaaatttcccaggacagagtcctccctcatcgcacccctcctagagacccccagccttacctacaacggttaacctggtccccgaaccgaaggtgtagccatagtcgacgttccgaaatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagttccgaaatggtcaactgagcgggctggcaaggc

SEQ ID NO: 848 - DNA, 495 bp, Artificial Sequence
  source: /note="Description of Artificial Sequence: Synthetic polynucleotide"
gcctccctcgcgccatcagcgttacttatggtcaactggattccagcccctttttgcaagttcccagctgtccagccttgacttactcacctacaacagtgagccaacttccctctccaaaatatatggtgtttcgtcgaccgttacttatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacgttacttatggtcaactgagcgggctggcaaggc

SEQ ID NO: 849 - DNA, 495 bp, Artificial Sequence
  source: /note="Description of Artificial Sequence: Synthetic polynucleotide"
gcctccctcgcgccatcagtaggagacatggtcaactcctggaactccgaccttatgatacactatcccgaaagaagtcttttacatacccaagacagagagctgggttccactgccaaaaaacagtttttcattgtcgactaggagacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagataggagacatggtcaactgagcgggctggcaaggc

SEQ ID NO: 850 - DNA, 495 bp, Artificial Sequence
  source: /note="Description of Artificial Sequence: Synthetic polynucleotide"
gcctccctcgcgccatcaggacactctatggtcaaagagaactctgccttcaagggacaatggccataccaccctgattctgcaacttacctaggatggagagtcgagtcccatcaccaaaatgctggggctgatgtcgacgacactctatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagacactctatggtcaactgagcgggctggcaaggc

SEQ ID NO: 851 - DNA, 495 bp, Artificial Sequence
  source: /note="Description of Artificial Sequence: Synthetic polynucleotide"
gcctccctcgcgccatcagttcggaacatggtcaaatcattgcagtcaaacccaggcacccccgagtcaagagtggagcccccatacctgtcacagtgagcctggtcccgttcccaaagtggaggggtgaattatgtcgacttcggaacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagattcggaacatggtcaactgagcgggctggcaaggc

SEQ ID NO: 852 - DNA, 495 bp, Artificial Sequence
  source: /note="Description of Artificial Sequence: Synthetic polynucleotide"
gcctccctcgcgccatcagaagtaacgatggtcaagggtcgtgcaggctgggctgctcaccctctctcccacctggagcccccttcttacctagcacggtgagccgtgtccctggcccgaagaactgctcattgtgtcgacaagtaacgatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagaaagtaacgatggtcaactgagcgggctggcaaggc

SEQ ID NO: 853 - DNA, 495 bp, Artificial Sequence
  source: /note="Description of Artificial Sequence: Synthetic polynucleotide"
gcctccctcgcgccatcaggtctcctaatggtcaacctctgcccatcccgccctctcggagctctccggagccccaaccgcctccttacccagtacggtcagcctagagccttctccaaaaaacagctccccggtgtcgacgtctcctaatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagtctcctaatggtcaactgagcgggctggcaaggc

SEQ ID NO: 854 - DNA, 495 bp, Artificial Sequence
  source: /note="Description of Artificial Sequence: Synthetic polynucleotide"
gcctccctcgcgccatcaggtagacacatggtcaagcgtcccggggcgccccctccccagttccggggcttcagcgggagcccccgcttaccgagcactgtcagccgggtgcctgggccaaaatactgcgtatctgtcgacgtagacacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagtagacacatggtcaactgagcgggctggcaaggc

SEQ ID NO: 855 - DNA, 495 bp, Artificial Sequence
  source: /note="Description of Artificial Sequence: Synthetic polynucleotide"
gcctccctcgcgccatcagcactgtacatggtcaacgcacaaaaacccgagcgcagtctcgtccccggtcccccggcggccccagcttacccagcactgagagccgggtcccggcgccgaagtactgaatgttttgtcgaccactgtacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacactgtacatggtcaactgagcgggctggcaaggc

SEQ ID NO: 856 - DNA, 495 bp, Artificial Sequence
  source: /note="Description of Artificial Sequence: Synthetic polynucleotide"
gcctccctcgcgccatcaggatgatccatggtcaaccccgcaaaaaccagacccaagccgcccgcgcccgcgccccagcagcccgcgctcaccgagcaccaggagccgcgtgcctggcccgaagtactgggtctcgtcgacgatgatccatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagatgatccatggtcaactgagcgggctggcaaggc

SEQ ID NO: 857 - DNA, 495 bp, Artificial Sequence
  source: /note="Description of Artificial Sequence: Synthetic polynucleotide"
gcctccctcgcgccatcagcgccaataatggtcaaccgccgccttccacctgaatcccgccgcccgggtggtcccgcgaaaactcacccagcacggtcagcctgctgccggccccgaaagtcaggacgttggcccgtcgaccgccaataatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacgccaataatggtcaactgagcgggctggcaaggc

SEQ ID NO: 858 - DNA, 495 bp, Artificial Sequence
  source: /note="Description of Artificial Sequence: Synthetic polynucleotide"
gcctccctcgcgccatcagtcaagcctatggtcaaccaccctccgactccggggaccgaggggctggaaggtggggagacgcccgaatctcacctgtgaccgtgagcctggtgcccggcccgaagtactgctcgtgtcgactcaagcctatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagatcaagcctatggtcaactgagcgggctggcaaggc

SEQ ID NO: 859 - DNA, 495 bp, Artificial Sequence
  source: /note="Description of Artificial Sequence: Synthetic polynucleotide"
gcctccctcgcgccatcagagagtgtccaagtcacctgtggacccacttttccctgtgacggatctgcaaaagaacctgaaaaatgtcttacctacaactgtgagtctggtgccttgtccaaagaaagcttcagtgtcgacagagtgtccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgagagtgtccaagtcacctgagcgggctggcaaggc

SEQ ID NO: 860 - DNA, 495 bp, Artificial Sequence
  source: /note="Description of Artificial Sequence: Synthetic polynucleotide"
gcctccctcgcgccatcaggttccgaacaagtcacatttcccaggacagagtcctccctcatcgcacccctcctagagacccccagccttacctacaacggttaacctggtccccgaaccgaaggtgtagccatagtcgacgttccgaacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggttccgaacaagtcacctgagcgggctggcaaggc

SEQ ID NO: 861 - DNA, 495 bp, Artificial Sequence
  source: /note="Description of Artificial Sequence: Synthetic polynucleotide"
gcctccctcgcgccatcagcgttacttcaagtcacctggattccagcccctttttgcaagttcccagctgtccagccttgacttactcacctacaacagtgagccaacttccctctccaaaatatatggtgtttcgtcgaccgttacttcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcgttacttcaagtcacctgagcgggctggcaaggc

SEQ ID NO: 862 - DNA, 495 bp, Artificial Sequence
  source: /note="Description of Artificial Sequence: Synthetic polynucleotide"
gcctccctcgcgccatcagtaggagaccaagtcacctcctggaactccgaccttatgatacactatcccgaaagaagtcttttacatacccaagacagagagctgggttccactgccaaaaaacagtttttcattgtcgactaggagaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgtaggagaccaagtcacctgagcgggctggcaaggc

SEQ ID NO: 863 - DNA, 495 bp, Artificial Sequence
  source: /note="Description of Artificial Sequence: Synthetic polynucleotide"
gcctccctcgcgccatcaggacactctcaagtcacagagaactctgccttcaagggacaatggccataccaccctgattctgcaacttacctaggatggagagtcgagtcccatcaccaaaatgctggggctgatgtcgacgacactctcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggacactctcaagtcacctgagcgggctggcaaggc

SEQ ID NO: 864 - DNA, 495 bp, Artificial Sequence
  source: /note="Description of Artificial Sequence: Synthetic polynucleotide"
gcctccctcgcgccatcagttcggaaccaagtcacatcattgcagtcaaacccaggcacccccgagtcaagagtggagcccccatacctgtcacagtgagcctggtcccgttcccaaagtggaggggtgaattatgtcgacttcggaaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgttcggaaccaagtcacctgagcgggctggcaaggc

SEQ ID NO: 865 - DNA, 495 bp, Artificial Sequence
  source: /note="Description of Artificial Sequence: Synthetic polynucleotide"
gcctccctcgcgccatcagaagtaacgcaagtcacgggtcgtgcaggctgggctgctcaccctctctcccacctggagcccccttcttacctagcacggtgagccgtgtccctggcccgaagaactgctcattgtgtcgacaagtaacgcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgaagtaacgcaagtcacctgagcgggctggcaaggc

SEQ ID NO: 866 - DNA, 495 bp, Artificial Sequence
  source: /note="Description of Artificial Sequence: Synthetic polynucleotide"
gcctccctcgcgccatcaggtctcctacaagtcaccctctgcccatcccgccctctcggagctctccggagccccaaccgcctccttacccagtacggtcagcctagagccttctccaaaaaacagctccccggtgtcgacgtctcctacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggtctcctacaagtcacctgagcgggctggcaaggc

SEQ ID NO: 867 - DNA, 495 bp, Artificial Sequence
  source: /note="Description of Artificial Sequence: Synthetic polynucleotide"
gcctccctcgcgccatcaggtagacaccaagtcacgcgtcccggggcgccccctccccagttccggggcttcagcgggagcccccgcttaccgagcactgtcagccgggtgcctgggccaaaatactgcgtatctgtcgacgtagacaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggtagacaccaagtcacctgagcgggctggcaaggc

SEQ ID NO: 868 - DNA, 495 bp, Artificial Sequence
  source: /note="Description of Artificial Sequence: Synthetic polynucleotide"
gcctccctcgcgccatcagcactgtaccaagtcaccgcacaaaaacccgagcgcagtctcgtccccggtcccccggcggccccagcttacccagcactgagagccgggtcccggcgccgaagtactgaatgttttgtcgaccactgtaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcactgtaccaagtcacctgagcgggctggcaaggc

SEQ ID NO: 869 - DNA, 495 bp, Artificial Sequence
  source: /note="Description of Artificial Sequence: Synthetic polynucleotide"
gcctccctcgcgccatcaggatgatcccaagtcacccccgcaaaaaccagacccaagccgcccgcgcccgcgccccagcagcccgcgctcaccgagcaccaggagccgcgtgcctggcccgaagtactgggtctcgtcgacgatgatcccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggatgatcccaagtcacctgagcgggctggcaaggc

SEQ ID NO: 870 - DNA, 495 bp, Artificial Sequence
  source: /note="Description of Artificial Sequence: Synthetic polynucleotide"
gcctccctcgcgccatcagcgccaatacaagtcacccgccgccttccacctgaatcccgccgcccgggtggtcccgcgaaaactcacccagcacggtcagcctgctgccggccccgaaagtcaggacgttggcccgtcgaccgccaatacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcgccaatacaagtcacctgagcgggctggcaaggc

SEQ ID NO: 871 - DNA, 495 bp, Artificial Sequence
  source: /note="Description of Artificial Sequence: Synthetic polynucleotide"
gcctccctcgcgccatcagtcaagcctcaagtcacccaccctccgactccggggaccgaggggctggaaggtggggagacgcccgaatctcacctgtgaccgtgagcctggtgcccggcccgaagtactgctcgtgtcgactcaagcctcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgtcaagcctcaagtcacctgagcgggctggcaaggc

SEQ ID NO: 872 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacactgaagctttctttggacaaggcaccagactcacagttgtaggtaagacatttttcaggttcttttgcagatccggcatgcat

SEQ ID NO: 873 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacactgaagctttctttggacaaggcaccagactcacagttgtaggtaagacatttttcaggttcttttgcagatccggcatgcat

SEQ ID NO: 874 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacactgaagctttctttggacaaggcaccagactcacagttgtaggtaagacatttttcaggttcttttgcagatccggcatgcat

SEQ ID NO: 875 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacactgaagctttctttggacaaggcaccagactcacagttgtaggtaagacatttttcaggttcttttgcagatccggcatgcat

SEQ ID NO: 876 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacactgaagctttctttggacaaggcaccagactcacagttgtaggtaagacatttttcaggttcttttgcagatccggcatgcat

SEQ ID NO: 877 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacactgaagctttctttggacaaggcaccagactcacagttgtaggtaagacatttttcaggttcttttgcagatccggcatgcat

SEQ ID NO: 878 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacactgaagctttctttggacaaggcaccagactcacagttgtaggtaagacatttttcaggttcttttgcagatccggcatgcat

SEQ ID NO: 879 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacactgaagctttctttggacaaggcaccagactcacagttgtaggtaagacatttttcaggttcttttgcagatccggcatgcat

SEQ ID NO: 880 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacactgaagctttctttggacaaggcaccagactcacagttgtaggtaagacatttttcaggttcttttgcagatccggcatgcat

SEQ ID NO: 881 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacactgaagctttctttggacaaggcaccagactcacagttgtaggtaagacatttttcaggttcttttgcagatccggcatgcat

SEQ ID NO: 882 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacactgaagctttctttggacaaggcaccagactcacagttgtaggtaagacatttttcaggttcttttgcagatccggcatgcat

SEQ ID NO: 883 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacactgaagctttctttggacaaggcaccagactcacagttgtaggtaagacatttttcaggttcttttgcagatccggcatgcat

SEQ ID NO: 884 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacactgaagctttctttggacaaggcaccagactcacagttgtaggtaagacatttttcaggttcttttgcagatccggcatgcat

SEQ ID NO: 885 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacactgaagctttctttggacaaggcaccagactcacagttgtaggtaagacatttttcaggttcttttgcagatccggcatgcat

SEQ ID NO: 886 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacactgaagctttctttggacaaggcaccagactcacagttgtaggtaagacatttttcaggttcttttgcagatccggcatgcat

SEQ ID NO: 887 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacactgaagctttctttggacaaggcaccagactcacagttgtaggtaagacatttttcaggttcttttgcagatccggcatgcat

SEQ ID NO: 888 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacactgaagctttctttggacaaggcaccagactcacagttgtaggtaagacatttttcaggttcttttgcagatccggcatgcat

SEQ ID NO: 889 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacactgaagctttctttggacaaggcaccagactcacagttgtaggtaagacatttttcaggttcttttgcagatccggcatgcat

SEQ ID NO: 890 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacactgaagctttctttggacaaggcaccagactcacagttgtaggtaagacatttttcaggttcttttgcagatccggcatgcat

SEQ ID NO: 891 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacactgaagctttctttggacaaggcaccagactcacagttgtaggtaagacatttttcaggttcttttgcagatccggcatgcat

SEQ ID NO: 892 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacactgaagctttctttggacaaggcaccagactcacagttgtaggtaagacatttttcaggttcttttgcagatccggcatgcat

SEQ ID NO: 893 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacactgaagctttctttggacaaggcaccagactcacagttgtaggtaagacatttttcaggttcttttgcagatccggcatgcat

SEQ ID NO: 894 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacactgaagctttctttggacaaggcaccagactcacagttgtaggtaagacatttttcaggttcttttgcagatccggcatgcat

SEQ ID NO: 895 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacactgaagctttctttggacaaggcaccagactcacagttgtaggtaagacatttttcaggttcttttgcagatccggcatgcat

SEQ ID NO: 896 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacactgaagctttctttggacaaggcaccagactcacagttgtaggtaagacatttttcaggttcttttgcagatccggcatgcat

SEQ ID NO: 897 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacactgaagctttctttggacaaggcaccagactcacagttgtaggtaagacatttttcaggttcttttgcagatccggcatgcat

SEQ ID NO: 898 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacactgaagctttctttggacaaggcaccagactcacagttgtaggtaagacatttttcaggttcttttgcagatccggcatgcat

SEQ ID NO: 899 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacactgaagctttctttggacaaggcaccagactcacagttgtaggtaagacatttttcaggttcttttgcagatccggcatgcat

SEQ ID NO: 900 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacactgaagctttctttggacaaggcaccagactcacagttgtaggtaagacatttttcaggttcttttgcagatccggcatgcat

SEQ ID NO: 901 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacactgaagctttctttggacaaggcaccagactcacagttgtaggtaagacatttttcaggttcttttgcagatccggcatgcat

SEQ ID NO: 902 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacactgaagctttctttggacaaggcaccagactcacagttgtaggtaagacatttttcaggttcttttgcagatccggcatgcat

SEQ ID NO: 903 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacactgaagctttctttggacaaggcaccagactcacagttgtaggtaagacatttttcaggttcttttgcagatccggcatgcat

SEQ ID NO: 904 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacactgaagctttctttggacaaggcaccagactcacagttgtaggtaagacatttttcaggttcttttgcagatccggcatgcat

SEQ ID NO: 905 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacactgaagctttctttggacaaggcaccagactcacagttgtaggtaagacatttttcaggttcttttgcagatccggcatgcat

SEQ ID NO: 906 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacactgaagctttctttggacaaggcaccagactcacagttgtaggtaagacatttttcaggttcttttgcagatccggcatgcat

SEQ ID NO: 907 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacactgaagctttctttggacaaggcaccagactcacagttgtaggtaagacatttttcaggttcttttgcagatccggcatgcat

SEQ ID NO: 908 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacactgaagctttctttggacaaggcaccagactcacagttgtaggtaagacatttttcaggttcttttgcagatccggcatgcat

SEQ ID NO: 909 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacactgaagctttctttggacaaggcaccagactcacagttgtaggtaagacatttttcaggttcttttgcagatccggcatgcat

SEQ ID NO: 910 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacactgaagctttctttggacaaggcaccagactcacagttgtaggtaagacatttttcaggttcttttgcagatccggcatgcat

SEQ ID NO: 911 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacactgaagctttctttggacaaggcaccagactcacagttgtaggtaagacatttttcaggttcttttgcagatccggcatgcat

SEQ ID NO: 912 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacactgaagctttctttggacaaggcaccagactcacagttgtaggtaagacatttttcaggttcttttgcagatccggcatgcat

SEQ ID NO: 913 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacactgaagctttctttggacaaggcaccagactcacagttgtaggtaagacatttttcaggttcttttgcagatccggcatgcat

SEQ ID NO: 914 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacactgaagctttctttggacaaggcaccagactcacagttgtaggtaagacatttttcaggttcttttgcagatccggcatgcat

SEQ ID NO: 915 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacactgaagctttctttggacaaggcaccagactcacagttgtaggtaagacatttttcaggttcttttgcagatccggcatgcat

SEQ ID NO: 916 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacactgaagctttctttggacaaggcaccagactcacagttgtaggtaagacatttttcaggttcttttgcagatccggcatgcat

SEQ ID NO: 917 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacactgaagctttctttggacaaggcaccagactcacagttgtaggtaagacatttttcaggttcttttgcagatccggcatgcat

SEQ ID NO: 918 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacactgaagctttctttggacaaggcaccagactcacagttgtaggtaagacatttttcaggttcttttgcagatccggcatgcat

SEQ ID NO: 919 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacactgaagctttctttggacaaggcaccagactcacagttgtaggtaagacatttttcaggttcttttgcagatccggcatgcat

SEQ ID NO: 920 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacactgaagctttctttggacaaggcaccagactcacagttgtaggtaagacatttttcaggttcttttgcagatccggcatgcat

SEQ ID NO: 921 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacactgaagctttctttggacaaggcaccagactcacagttgtaggtaagacatttttcaggttcttttgcagatccggcatgcat

SEQ ID NO: 922 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacactgaagctttctttggacaaggcaccagactcacagttgtaggtaagacatttttcaggttcttttgcagatccggcatgcat

SEQ ID NO: 923 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacactgaagctttctttggacaaggcaccagactcacagttgtaggtaagacatttttcaggttcttttgcagatccggcatgcat

SEQ ID NO: 924 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacactgaagctttctttggacaaggcaccagactcacagttgtaggtaagacatttttcaggttcttttgcagatccggcatgcat

SEQ ID NO: 925 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgactatggctacaccttcggttcggggaccaggttaaccgttgtaggtaaggctgggggtctctaggaggggtgcgatggcatgcat

SEQ ID NO: 926 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgactatggctacaccttcggttcggggaccaggttaaccgttgtaggtaaggctgggggtctctaggaggggtgcgatggcatgcat

SEQ ID NO: 927 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgactatggctacaccttcggttcggggaccaggttaaccgttgtaggtaaggctgggggtctctaggaggggtgcgatggcatgcat

SEQ ID NO: 928 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgactatggctacaccttcggttcggggaccaggttaaccgttgtaggtaaggctgggggtctctaggaggggtgcgatggcatgcat

SEQ ID NO: 929 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgactatggctacaccttcggttcggggaccaggttaaccgttgtaggtaaggctgggggtctctaggaggggtgcgatggcatgcat

SEQ ID NO: 930 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgactatggctacaccttcggttcggggaccaggttaaccgttgtaggtaaggctgggggtctctaggaggggtgcgatggcatgcat

SEQ ID NO: 931 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgactatggctacaccttcggttcggggaccaggttaaccgttgtaggtaaggctgggggtctctaggaggggtgcgatggcatgcat

SEQ ID NO: 932 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgactatggctacaccttcggttcggggaccaggttaaccgttgtaggtaaggctgggggtctctaggaggggtgcgatggcatgcat

SEQ ID NO: 933 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgactatggctacaccttcggttcggggaccaggttaaccgttgtaggtaaggctgggggtctctaggaggggtgcgatggcatgcat

SEQ ID NO: 934 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgactatggctacaccttcggttcggggaccaggttaaccgttgtaggtaaggctgggggtctctaggaggggtgcgatggcatgcat

SEQ ID NO: 935 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgactatggctacaccttcggttcggggaccaggttaaccgttgtaggtaaggctgggggtctctaggaggggtgcgatggcatgcat

SEQ ID NO: 936 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgactatggctacaccttcggttcggggaccaggttaaccgttgtaggtaaggctgggggtctctaggaggggtgcgatggcatgcat

SEQ ID NO: 937 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgactatggctacaccttcggttcggggaccaggttaaccgttgtaggtaaggctgggggtctctaggaggggtgcgatggcatgcat

SEQ ID NO: 938 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgactatggctacaccttcggttcggggaccaggttaaccgttgtaggtaaggctgggggtctctaggaggggtgcgatggcatgcat

SEQ ID NO: 939 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgactatggctacaccttcggttcggggaccaggttaaccgttgtaggtaaggctgggggtctctaggaggggtgcgatggcatgcat

SEQ ID NO: 940 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgactatggctacaccttcggttcggggaccaggttaaccgttgtaggtaaggctgggggtctctaggaggggtgcgatggcatgcat

SEQ ID NO: 941 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgactatggctacaccttcggttcggggaccaggttaaccgttgtaggtaaggctgggggtctctaggaggggtgcgatggcatgcat

SEQ ID NO: 942 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgactatggctacaccttcggttcggggaccaggttaaccgttgtaggtaaggctgggggtctctaggaggggtgcgatggcatgcat

SEQ ID NO: 943 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgactatggctacaccttcggttcggggaccaggttaaccgttgtaggtaaggctgggggtctctaggaggggtgcgatggcatgcat

SEQ ID NO: 944 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgactatggctacaccttcggttcggggaccaggttaaccgttgtaggtaaggctgggggtctctaggaggggtgcgatggcatgcat

SEQ ID NO: 945 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgactatggctacaccttcggttcggggaccaggttaaccgttgtaggtaaggctgggggtctctaggaggggtgcgatggcatgcat

SEQ ID NO: 946 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgactatggctacaccttcggttcggggaccaggttaaccgttgtaggtaaggctgggggtctctaggaggggtgcgatggcatgcat

SEQ ID NO: 947 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgactatggctacaccttcggttcggggaccaggttaaccgttgtaggtaaggctgggggtctctaggaggggtgcgatggcatgcat

SEQ ID NO: 948 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgactatggctacaccttcggttcggggaccaggttaaccgttgtaggtaaggctgggggtctctaggaggggtgcgatggcatgcat

SEQ ID NO: 949 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgactatggctacaccttcggttcggggaccaggttaaccgttgtaggtaaggctgggggtctctaggaggggtgcgatggcatgcat

SEQ ID NO: 950 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgactatggctacaccttcggttcggggaccaggttaaccgttgtaggtaaggctgggggtctctaggaggggtgcgatggcatgcat

SEQ ID NO: 951 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgactatggctacaccttcggttcggggaccaggttaaccgttgtaggtaaggctgggggtctctaggaggggtgcgatggcatgcat

SEQ ID NO: 952 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgactatggctacaccttcggttcggggaccaggttaaccgttgtaggtaaggctgggggtctctaggaggggtgcgatggcatgcat

SEQ ID NO: 953 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgactatggctacaccttcggttcggggaccaggttaaccgttgtaggtaaggctgggggtctctaggaggggtgcgatggcatgcat

SEQ ID NO: 954 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgactatggctacaccttcggttcggggaccaggttaaccgttgtaggtaaggctgggggtctctaggaggggtgcgatggcatgcat

SEQ ID NO: 955 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgactatggctacaccttcggttcggggaccaggttaaccgttgtaggtaaggctgggggtctctaggaggggtgcgatggcatgcat

SEQ ID NO: 956 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgactatggctacaccttcggttcggggaccaggttaaccgttgtaggtaaggctgggggtctctaggaggggtgcgatggcatgcat

SEQ ID NO: 957 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgactatggctacaccttcggttcggggaccaggttaaccgttgtaggtaaggctgggggtctctaggaggggtgcgatggcatgcat

SEQ ID NO: 958 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgactatggctacaccttcggttcggggaccaggttaaccgttgtaggtaaggctgggggtctctaggaggggtgcgatggcatgcat

SEQ ID NO: 959 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgactatggctacaccttcggttcggggaccaggttaaccgttgtaggtaaggctgggggtctctaggaggggtgcgatggcatgcat

SEQ ID NO: 960 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgactatggctacaccttcggttcggggaccaggttaaccgttgtaggtaaggctgggggtctctaggaggggtgcgatggcatgcat

SEQ ID NO: 961 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgactatggctacaccttcggttcggggaccaggttaaccgttgtaggtaaggctgggggtctctaggaggggtgcgatggcatgcat

SEQ ID NO: 962 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgactatggctacaccttcggttcggggaccaggttaaccgttgtaggtaaggctgggggtctctaggaggggtgcgatggcatgcat

SEQ ID NO: 963 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgactatggctacaccttcggttcggggaccaggttaaccgttgtaggtaaggctgggggtctctaggaggggtgcgatggcatgcat

SEQ ID NO: 964 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgactatggctacaccttcggttcggggaccaggttaaccgttgtaggtaaggctgggggtctctaggaggggtgcgatggcatgcat

SEQ ID NO: 965 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgactatggctacaccttcggttcggggaccaggttaaccgttgtaggtaaggctgggggtctctaggaggggtgcgatggcatgcat

SEQ ID NO: 966 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgactatggctacaccttcggttcggggaccaggttaaccgttgtaggtaaggctgggggtctctaggaggggtgcgatggcatgcat

SEQ ID NO: 967 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgactatggctacaccttcggttcggggaccaggttaaccgttgtaggtaaggctgggggtctctaggaggggtgcgatggcatgcat

SEQ ID NO: 968 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgactatggctacaccttcggttcggggaccaggttaaccgttgtaggtaaggctgggggtctctaggaggggtgcgatggcatgcat

SEQ ID NO: 969 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgactatggctacaccttcggttcggggaccaggttaaccgttgtaggtaaggctgggggtctctaggaggggtgcgatggcatgcat

SEQ ID NO: 970 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgactatggctacaccttcggttcggggaccaggttaaccgttgtaggtaaggctgggggtctctaggaggggtgcgatggcatgcat

SEQ ID NO: 971 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgactatggctacaccttcggttcggggaccaggttaaccgttgtaggtaaggctgggggtctctaggaggggtgcgatggcatgcat

SEQ ID NO: 972 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgactatggctacaccttcggttcggggaccaggttaaccgttgtaggtaaggctgggggtctctaggaggggtgcgatggcatgcat

SEQ ID NO: 973 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgactatggctacaccttcggttcggggaccaggttaaccgttgtaggtaaggctgggggtctctaggaggggtgcgatggcatgcat

SEQ ID NO: 974 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgactatggctacaccttcggttcggggaccaggttaaccgttgtaggtaaggctgggggtctctaggaggggtgcgatggcatgcat

SEQ ID NO: 975 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgactatggctacaccttcggttcggggaccaggttaaccgttgtaggtaaggctgggggtctctaggaggggtgcgatggcatgcat

SEQ ID NO: 976 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgactatggctacaccttcggttcggggaccaggttaaccgttgtaggtaaggctgggggtctctaggaggggtgcgatggcatgcat

SEQ ID NO: 977 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgactatggctacaccttcggttcggggaccaggttaaccgttgtaggtaaggctgggggtctctaggaggggtgcgatggcatgcat

SEQ ID NO: 978 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgaaacaccatatattttggagagggaagttggctcactgttgtaggtgagtaagtcaaggctggacagctgggaacgcatgcat

SEQ ID NO: 979 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgaaacaccatatattttggagagggaagttggctcactgttgtaggtgagtaagtcaaggctggacagctgggaacgcatgcat

SEQ ID NO: 980 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgaaacaccatatattttggagagggaagttggctcactgttgtaggtgagtaagtcaaggctggacagctgggaacgcatgcat

SEQ ID NO: 981 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgaaacaccatatattttggagagggaagttggctcactgttgtaggtgagtaagtcaaggctggacagctgggaacgcatgcat

SEQ ID NO: 982 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgaaacaccatatattttggagagggaagttggctcactgttgtaggtgagtaagtcaaggctggacagctgggaacgcatgcat

SEQ ID NO: 983 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgaaacaccatatattttggagagggaagttggctcactgttgtaggtgagtaagtcaaggctggacagctgggaacgcatgcat

SEQ ID NO: 984 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgaaacaccatatattttggagagggaagttggctcactgttgtaggtgagtaagtcaaggctggacagctgggaacgcatgcat

SEQ ID NO: 985 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgaaacaccatatattttggagagggaagttggctcactgttgtaggtgagtaagtcaaggctggacagctgggaacgcatgcat

SEQ ID NO: 986 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgaaacaccatatattttggagagggaagttggctcactgttgtaggtgagtaagtcaaggctggacagctgggaacgcatgcat

SEQ ID NO: 987 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgaaacaccatatattttggagagggaagttggctcactgttgtaggtgagtaagtcaaggctggacagctgggaacgcatgcat

SEQ ID NO: 988 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgaaacaccatatattttggagagggaagttggctcactgttgtaggtgagtaagtcaaggctggacagctgggaacgcatgcat

SEQ ID NO: 989 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgaaacaccatatattttggagagggaagttggctcactgttgtaggtgagtaagtcaaggctggacagctgggaacgcatgcat

SEQ ID NO: 990 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgaaacaccatatattttggagagggaagttggctcactgttgtaggtgagtaagtcaaggctggacagctgggaacgcatgcat

SEQ ID NO: 991 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgaaacaccatatattttggagagggaagttggctcactgttgtaggtgagtaagtcaaggctggacagctgggaacgcatgcat

SEQ ID NO: 992 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgaaacaccatatattttggagagggaagttggctcactgttgtaggtgagtaagtcaaggctggacagctgggaacgcatgcat

SEQ ID NO: 993 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgaaacaccatatattttggagagggaagttggctcactgttgtaggtgagtaagtcaaggctggacagctgggaacgcatgcat

SEQ ID NO: 994 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgaaacaccatatattttggagagggaagttggctcactgttgtaggtgagtaagtcaaggctggacagctgggaacgcatgcat

SEQ ID NO: 995 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgaaacaccatatattttggagagggaagttggctcactgttgtaggtgagtaagtcaaggctggacagctgggaacgcatgcat

SEQ ID NO: 996 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgaaacaccatatattttggagagggaagttggctcactgttgtaggtgagtaagtcaaggctggacagctgggaacgcatgcat

SEQ ID NO: 997 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgaaacaccatatattttggagagggaagttggctcactgttgtaggtgagtaagtcaaggctggacagctgggaacgcatgcat

SEQ ID NO: 998 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgaaacaccatatattttggagagggaagttggctcactgttgtaggtgagtaagtcaaggctggacagctgggaacgcatgcat

SEQ ID NO: 999 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgaaacaccatatattttggagagggaagttggctcactgttgtaggtgagtaagtcaaggctggacagctgggaacgcatgcat

SEQ ID NO: 1000 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgaaacaccatatattttggagagggaagttggctcactgttgtaggtgagtaagtcaaggctggacagctgggaacgcatgcat

SEQ ID NO: 1001 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgaaacaccatatattttggagagggaagttggctcactgttgtaggtgagtaagtcaaggctggacagctgggaacgcatgcat

SEQ ID NO: 1002 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgaaacaccatatattttggagagggaagttggctcactgttgtaggtgagtaagtcaaggctggacagctgggaacgcatgcat

SEQ ID NO: 1003 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgaaacaccatatattttggagagggaagttggctcactgttgtaggtgagtaagtcaaggctggacagctgggaacgcatgcat

SEQ ID NO: 1004 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgaaacaccatatattttggagagggaagttggctcactgttgtaggtgagtaagtcaaggctggacagctgggaacgcatgcat

SEQ ID NO: 1005 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgaaacaccatatattttggagagggaagttggctcactgttgtaggtgagtaagtcaaggctggacagctgggaacgcatgcat

SEQ ID NO: 1006 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgaaacaccatatattttggagagggaagttggctcactgttgtaggtgagtaagtcaaggctggacagctgggaacgcatgcat

SEQ ID NO: 1007 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgaaacaccatatattttggagagggaagttggctcactgttgtaggtgagtaagtcaaggctggacagctgggaacgcatgcat

SEQ ID NO: 1008 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgaaacaccatatattttggagagggaagttggctcactgttgtaggtgagtaagtcaaggctggacagctgggaacgcatgcat

SEQ ID NO: 1009 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgaaacaccatatattttggagagggaagttggctcactgttgtaggtgagtaagtcaaggctggacagctgggaacgcatgcat

SEQ ID NO: 1010 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgaaacaccatatattttggagagggaagttggctcactgttgtaggtgagtaagtcaaggctggacagctgggaacgcatgcat

SEQ ID NO: 1011 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgaaacaccatatattttggagagggaagttggctcactgttgtaggtgagtaagtcaaggctggacagctgggaacgcatgcat

SEQ ID NO: 1012 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgaaacaccatatattttggagagggaagttggctcactgttgtaggtgagtaagtcaaggctggacagctgggaacgcatgcat

SEQ ID NO: 1013 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgaaacaccatatattttggagagggaagttggctcactgttgtaggtgagtaagtcaaggctggacagctgggaacgcatgcat

SEQ ID NO: 1014 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgaaacaccatatattttggagagggaagttggctcactgttgtaggtgagtaagtcaaggctggacagctgggaacgcatgcat

SEQ ID NO: 1015 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgaaacaccatatattttggagagggaagttggctcactgttgtaggtgagtaagtcaaggctggacagctgggaacgcatgcat

SEQ ID NO: 1016 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgaaacaccatatattttggagagggaagttggctcactgttgtaggtgagtaagtcaaggctggacagctgggaacgcatgcat

SEQ ID NO: 1017 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgaaacaccatatattttggagagggaagttggctcactgttgtaggtgagtaagtcaaggctggacagctgggaacgcatgcat

SEQ ID NO: 1018 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgaaacaccatatattttggagagggaagttggctcactgttgtaggtgagtaagtcaaggctggacagctgggaacgcatgcat

SEQ ID NO: 1019 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgaaacaccatatattttggagagggaagttggctcactgttgtaggtgagtaagtcaaggctggacagctgggaacgcatgcat

SEQ ID NO: 1020 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgaaacaccatatattttggagagggaagttggctcactgttgtaggtgagtaagtcaaggctggacagctgggaacgcatgcat

SEQ ID NO: 1021 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgaaacaccatatattttggagagggaagttggctcactgttgtaggtgagtaagtcaaggctggacagctgggaacgcatgcat

SEQ ID NO: 1022 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgaaacaccatatattttggagagggaagttggctcactgttgtaggtgagtaagtcaaggctggacagctgggaacgcatgcat

SEQ ID NO: 1023 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgaaacaccatatattttggagagggaagttggctcactgttgtaggtgagtaagtcaaggctggacagctgggaacgcatgcat

SEQ ID NO: 1024 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgaaacaccatatattttggagagggaagttggctcactgttgtaggtgagtaagtcaaggctggacagctgggaacgcatgcat

SEQ ID NO: 1025 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgaaacaccatatattttggagagggaagttggctcactgttgtaggtgagtaagtcaaggctggacagctgggaacgcatgcat

SEQ ID NO: 1026 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgaaacaccatatattttggagagggaagttggctcactgttgtaggtgagtaagtcaaggctggacagctgggaacgcatgcat

SEQ ID NO: 1027 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgaaacaccatatattttggagagggaagttggctcactgttgtaggtgagtaagtcaaggctggacagctgggaacgcatgcat

SEQ ID NO: 1028 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgaaacaccatatattttggagagggaagttggctcactgttgtaggtgagtaagtcaaggctggacagctgggaacgcatgcat

SEQ ID NO: 1029 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgaaacaccatatattttggagagggaagttggctcactgttgtaggtgagtaagtcaaggctggacagctgggaacgcatgcat

SEQ ID NO: 1030 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgaaacaccatatattttggagagggaagttggctcactgttgtaggtgagtaagtcaaggctggacagctgggaacgcatgcat

SEQ ID NO: 1031 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaatgaaaaactgttttttggcagtggaacccagctctctgtcttgggtatgtaaaagacttctttcgggatagtgtgcatgcat

SEQ ID NO: 1032 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaatgaaaaactgttttttggcagtggaacccagctctctgtcttgggtatgtaaaagacttctttcgggatagtgtgcatgcat

SEQ ID NO: 1033 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaatgaaaaactgttttttggcagtggaacccagctctctgtcttgggtatgtaaaagacttctttcgggatagtgtgcatgcat

SEQ ID NO: 1034 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaatgaaaaactgttttttggcagtggaacccagctctctgtcttgggtatgtaaaagacttctttcgggatagtgtgcatgcat

SEQ ID NO: 1035 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaatgaaaaactgttttttggcagtggaacccagctctctgtcttgggtatgtaaaagacttctttcgggatagtgtgcatgcat

SEQ ID NO: 1036 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaatgaaaaactgttttttggcagtggaacccagctctctgtcttgggtatgtaaaagacttctttcgggatagtgtgcatgcat

SEQ ID NO: 1037 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaatgaaaaactgttttttggcagtggaacccagctctctgtcttgggtatgtaaaagacttctttcgggatagtgtgcatgcat

SEQ ID NO: 1038 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaatgaaaaactgttttttggcagtggaacccagctctctgtcttgggtatgtaaaagacttctttcgggatagtgtgcatgcat

SEQ ID NO: 1039 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaatgaaaaactgttttttggcagtggaacccagctctctgtcttgggtatgtaaaagacttctttcgggatagtgtgcatgcat

SEQ ID NO: 1040 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaatgaaaaactgttttttggcagtggaacccagctctctgtcttgggtatgtaaaagacttctttcgggatagtgtgcatgcat

SEQ ID NO: 1041 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaatgaaaaactgttttttggcagtggaacccagctctctgtcttgggtatgtaaaagacttctttcgggatagtgtgcatgcat

SEQ ID NO: 1042 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaatgaaaaactgttttttggcagtggaacccagctctctgtcttgggtatgtaaaagacttctttcgggatagtgtgcatgcat

SEQ ID NO: 1043 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaatgaaaaactgttttttggcagtggaacccagctctctgtcttgggtatgtaaaagacttctttcgggatagtgtgcatgcat

SEQ ID NO: 1044 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaatgaaaaactgttttttggcagtggaacccagctctctgtcttgggtatgtaaaagacttctttcgggatagtgtgcatgcat

SEQ ID NO: 1045 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaatgaaaaactgttttttggcagtggaacccagctctctgtcttgggtatgtaaaagacttctttcgggatagtgtgcatgcat

SEQ ID NO: 1046 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaatgaaaaactgttttttggcagtggaacccagctctctgtcttgggtatgtaaaagacttctttcgggatagtgtgcatgcat

SEQ ID NO: 1047 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaatgaaaaactgttttttggcagtggaacccagctctctgtcttgggtatgtaaaagacttctttcgggatagtgtgcatgcat

SEQ ID NO: 1048 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaatgaaaaactgttttttggcagtggaacccagctctctgtcttgggtatgtaaaagacttctttcgggatagtgtgcatgcat

SEQ ID NO: 1049 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaatgaaaaactgttttttggcagtggaacccagctctctgtcttgggtatgtaaaagacttctttcgggatagtgtgcatgcat

SEQ ID NO: 1050 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaatgaaaaactgttttttggcagtggaacccagctctctgtcttgggtatgtaaaagacttctttcgggatagtgtgcatgcat

SEQ ID NO: 1051 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaatgaaaaactgttttttggcagtggaacccagctctctgtcttgggtatgtaaaagacttctttcgggatagtgtgcatgcat

SEQ ID NO: 1052 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaatgaaaaactgttttttggcagtggaacccagctctctgtcttgggtatgtaaaagacttctttcgggatagtgtgcatgcat

SEQ ID NO: 1053 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaatgaaaaactgttttttggcagtggaacccagctctctgtcttgggtatgtaaaagacttctttcgggatagtgtgcatgcat

SEQ ID NO: 1054 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaatgaaaaactgttttttggcagtggaacccagctctctgtcttgggtatgtaaaagacttctttcgggatagtgtgcatgcat

SEQ ID NO: 1055 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaatgaaaaactgttttttggcagtggaacccagctctctgtcttgggtatgtaaaagacttctttcgggatagtgtgcatgcat

SEQ ID NO: 1056 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaatgaaaaactgttttttggcagtggaacccagctctctgtcttgggtatgtaaaagacttctttcgggatagtgtgcatgcat

SEQ ID NO: 1057 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaatgaaaaactgttttttggcagtggaacccagctctctgtcttgggtatgtaaaagacttctttcgggatagtgtgcatgcat

SEQ ID NO: 1058 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaatgaaaaactgttttttggcagtggaacccagctctctgtcttgggtatgtaaaagacttctttcgggatagtgtgcatgcat

SEQ ID NO: 1059 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaatgaaaaactgttttttggcagtggaacccagctctctgtcttgggtatgtaaaagacttctttcgggatagtgtgcatgcat

SEQ ID NO: 1060 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaatgaaaaactgttttttggcagtggaacccagctctctgtcttgggtatgtaaaagacttctttcgggatagtgtgcatgcat

SEQ ID NO: 1061 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaatgaaaaactgttttttggcagtggaacccagctctctgtcttgggtatgtaaaagacttctttcgggatagtgtgcatgcat

SEQ ID NO: 1062 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaatgaaaaactgttttttggcagtggaacccagctctctgtcttgggtatgtaaaagacttctttcgggatagtgtgcatgcat

SEQ ID NO: 1063 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaatgaaaaactgttttttggcagtggaacccagctctctgtcttgggtatgtaaaagacttctttcgggatagtgtgcatgcat

SEQ ID NO: 1064 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaatgaaaaactgttttttggcagtggaacccagctctctgtcttgggtatgtaaaagacttctttcgggatagtgtgcatgcat

SEQ ID NO: 1065 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaatgaaaaactgttttttggcagtggaacccagctctctgtcttgggtatgtaaaagacttctttcgggatagtgtgcatgcat

SEQ ID NO: 1066 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaatgaaaaactgttttttggcagtggaacccagctctctgtcttgggtatgtaaaagacttctttcgggatagtgtgcatgcat

SEQ ID NO: 1067 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaatgaaaaactgttttttggcagtggaacccagctctctgtcttgggtatgtaaaagacttctttcgggatagtgtgcatgcat

SEQ ID NO: 1068 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaatgaaaaactgttttttggcagtggaacccagctctctgtcttgggtatgtaaaagacttctttcgggatagtgtgcatgcat

SEQ ID NO: 1069 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaatgaaaaactgttttttggcagtggaacccagctctctgtcttgggtatgtaaaagacttctttcgggatagtgtgcatgcat

SEQ ID NO: 1070 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaatgaaaaactgttttttggcagtggaacccagctctctgtcttgggtatgtaaaagacttctttcgggatagtgtgcatgcat

SEQ ID NO: 1071 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaatgaaaaactgttttttggcagtggaacccagctctctgtcttgggtatgtaaaagacttctttcgggatagtgtgcatgcat

SEQ ID NO: 1072 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaatgaaaaactgttttttggcagtggaacccagctctctgtcttgggtatgtaaaagacttctttcgggatagtgtgcatgcat

SEQ ID NO: 1073 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaatgaaaaactgttttttggcagtggaacccagctctctgtcttgggtatgtaaaagacttctttcgggatagtgtgcatgcat

SEQ ID NO: 1074 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaatgaaaaactgttttttggcagtggaacccagctctctgtcttgggtatgtaaaagacttctttcgggatagtgtgcatgcat

SEQ ID NO: 1075 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaatgaaaaactgttttttggcagtggaacccagctctctgtcttgggtatgtaaaagacttctttcgggatagtgtgcatgcat

SEQ ID NO: 1076 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaatgaaaaactgttttttggcagtggaacccagctctctgtcttgggtatgtaaaagacttctttcgggatagtgtgcatgcat

SEQ ID NO: 1077 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaatgaaaaactgttttttggcagtggaacccagctctctgtcttgggtatgtaaaagacttctttcgggatagtgtgcatgcat

SEQ ID NO: 1078 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaatgaaaaactgttttttggcagtggaacccagctctctgtcttgggtatgtaaaagacttctttcgggatagtgtgcatgcat

SEQ ID NO: 1079 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaatgaaaaactgttttttggcagtggaacccagctctctgtcttgggtatgtaaaagacttctttcgggatagtgtgcatgcat

SEQ ID NO: 1080 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaatgaaaaactgttttttggcagtggaacccagctctctgtcttgggtatgtaaaagacttctttcgggatagtgtgcatgcat

SEQ ID NO: 1081 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaatgaaaaactgttttttggcagtggaacccagctctctgtcttgggtatgtaaaagacttctttcgggatagtgtgcatgcat

SEQ ID NO: 1082 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaatgaaaaactgttttttggcagtggaacccagctctctgtcttgggtatgtaaaagacttctttcgggatagtgtgcatgcat

SEQ ID NO: 1083 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaatgaaaaactgttttttggcagtggaacccagctctctgtcttgggtatgtaaaagacttctttcgggatagtgtgcatgcat

SEQ ID NO: 1084 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacatcagccccagcattttggtgatgggactcgactctccatcctaggtaagttgcagaatcagggtggtatggccatgcatgcat

SEQ ID NO: 1085 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacatcagccccagcattttggtgatgggactcgactctccatcctaggtaagttgcagaatcagggtggtatggccatgcatgcat

SEQ ID NO: 1086 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacatcagccccagcattttggtgatgggactcgactctccatcctaggtaagttgcagaatcagggtggtatggccatgcatgcat

SEQ ID NO: 1087 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacatcagccccagcattttggtgatgggactcgactctccatcctaggtaagttgcagaatcagggtggtatggccatgcatgcat

SEQ ID NO: 1088 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacatcagccccagcattttggtgatgggactcgactctccatcctaggtaagttgcagaatcagggtggtatggccatgcatgcat

SEQ ID NO: 1089 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacatcagccccagcattttggtgatgggactcgactctccatcctaggtaagttgcagaatcagggtggtatggccatgcatgcat

SEQ ID NO: 1090 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacatcagccccagcattttggtgatgggactcgactctccatcctaggtaagttgcagaatcagggtggtatggccatgcatgcat

SEQ ID NO: 1091 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacatcagccccagcattttggtgatgggactcgactctccatcctaggtaagttgcagaatcagggtggtatggccatgcatgcat

SEQ ID NO: 1092 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacatcagccccagcattttggtgatgggactcgactctccatcctaggtaagttgcagaatcagggtggtatggccatgcatgcat

SEQ ID NO: 1093 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacatcagccccagcattttggtgatgggactcgactctccatcctaggtaagttgcagaatcagggtggtatggccatgcatgcat

SEQ ID NO: 1094 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacatcagccccagcattttggtgatgggactcgactctccatcctaggtaagttgcagaatcagggtggtatggccatgcatgcat

SEQ ID NO: 1095 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacatcagccccagcattttggtgatgggactcgactctccatcctaggtaagttgcagaatcagggtggtatggccatgcatgcat

SEQ ID NO: 1096 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacatcagccccagcattttggtgatgggactcgactctccatcctaggtaagttgcagaatcagggtggtatggccatgcatgcat

SEQ ID NO: 1097 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacatcagccccagcattttggtgatgggactcgactctccatcctaggtaagttgcagaatcagggtggtatggccatgcatgcat

SEQ ID NO: 1098 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacatcagccccagcattttggtgatgggactcgactctccatcctaggtaagttgcagaatcagggtggtatggccatgcatgcat

SEQ ID NO: 1099 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacatcagccccagcattttggtgatgggactcgactctccatcctaggtaagttgcagaatcagggtggtatggccatgcatgcat

SEQ ID NO: 1100 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacatcagccccagcattttggtgatgggactcgactctccatcctaggtaagttgcagaatcagggtggtatggccatgcatgcat

SEQ ID NO: 1101 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacatcagccccagcattttggtgatgggactcgactctccatcctaggtaagttgcagaatcagggtggtatggccatgcatgcat

SEQ ID NO: 1102 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacatcagccccagcattttggtgatgggactcgactctccatcctaggtaagttgcagaatcagggtggtatggccatgcatgcat

SEQ ID NO: 1103 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacatcagccccagcattttggtgatgggactcgactctccatcctaggtaagttgcagaatcagggtggtatggccatgcatgcat

SEQ ID NO: 1104 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacatcagccccagcattttggtgatgggactcgactctccatcctaggtaagttgcagaatcagggtggtatggccatgcatgcat

SEQ ID NO: 1105 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacatcagccccagcattttggtgatgggactcgactctccatcctaggtaagttgcagaatcagggtggtatggccatgcatgcat

SEQ ID NO: 1106 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacatcagccccagcattttggtgatgggactcgactctccatcctaggtaagttgcagaatcagggtggtatggccatgcatgcat

SEQ ID NO: 1107 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacatcagccccagcattttggtgatgggactcgactctccatcctaggtaagttgcagaatcagggtggtatggccatgcatgcat

SEQ ID NO: 1108 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacatcagccccagcattttggtgatgggactcgactctccatcctaggtaagttgcagaatcagggtggtatggccatgcatgcat

SEQ ID NO: 1109 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacatcagccccagcattttggtgatgggactcgactctccatcctaggtaagttgcagaatcagggtggtatggccatgcatgcat

SEQ ID NO: 1110 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacatcagccccagcattttggtgatgggactcgactctccatcctaggtaagttgcagaatcagggtggtatggccatgcatgcat

SEQ ID NO: 1111 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacatcagccccagcattttggtgatgggactcgactctccatcctaggtaagttgcagaatcagggtggtatggccatgcatgcat

SEQ ID NO: 1112 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacatcagccccagcattttggtgatgggactcgactctccatcctaggtaagttgcagaatcagggtggtatggccatgcatgcat

SEQ ID NO: 1113 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacatcagccccagcattttggtgatgggactcgactctccatcctaggtaagttgcagaatcagggtggtatggccatgcatgcat

SEQ ID NO: 1114 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacatcagccccagcattttggtgatgggactcgactctccatcctaggtaagttgcagaatcagggtggtatggccatgcatgcat

SEQ ID NO: 1115 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacatcagccccagcattttggtgatgggactcgactctccatcctaggtaagttgcagaatcagggtggtatggccatgcatgcat

SEQ ID NO: 1116 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacatcagccccagcattttggtgatgggactcgactctccatcctaggtaagttgcagaatcagggtggtatggccatgcatgcat

SEQ ID NO: 1117 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacatcagccccagcattttggtgatgggactcgactctccatcctaggtaagttgcagaatcagggtggtatggccatgcatgcat

SEQ ID NO: 1118 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacatcagccccagcattttggtgatgggactcgactctccatcctaggtaagttgcagaatcagggtggtatggccatgcatgcat

SEQ ID NO: 1119 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacatcagccccagcattttggtgatgggactcgactctccatcctaggtaagttgcagaatcagggtggtatggccatgcatgcat

SEQ ID NO: 1120 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacatcagccccagcattttggtgatgggactcgactctccatcctaggtaagttgcagaatcagggtggtatggccatgcatgcat

SEQ ID NO: 1121 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacatcagccccagcattttggtgatgggactcgactctccatcctaggtaagttgcagaatcagggtggtatggccatgcatgcat

SEQ ID NO: 1122 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacatcagccccagcattttggtgatgggactcgactctccatcctaggtaagttgcagaatcagggtggtatggccatgcatgcat

SEQ ID NO: 1123 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacatcagccccagcattttggtgatgggactcgactctccatcctaggtaagttgcagaatcagggtggtatggccatgcatgcat

SEQ ID NO: 1124 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacatcagccccagcattttggtgatgggactcgactctccatcctaggtaagttgcagaatcagggtggtatggccatgcatgcat

SEQ ID NO: 1125 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacatcagccccagcattttggtgatgggactcgactctccatcctaggtaagttgcagaatcagggtggtatggccatgcatgcat

SEQ ID NO: 1126 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacatcagccccagcattttggtgatgggactcgactctccatcctaggtaagttgcagaatcagggtggtatggccatgcatgcat

SEQ ID NO: 1127 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacatcagccccagcattttggtgatgggactcgactctccatcctaggtaagttgcagaatcagggtggtatggccatgcatgcat

SEQ ID NO: 1128 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacatcagccccagcattttggtgatgggactcgactctccatcctaggtaagttgcagaatcagggtggtatggccatgcatgcat

SEQ ID NO: 1129 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacatcagccccagcattttggtgatgggactcgactctccatcctaggtaagttgcagaatcagggtggtatggccatgcatgcat

SEQ ID NO: 1130 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacatcagccccagcattttggtgatgggactcgactctccatcctaggtaagttgcagaatcagggtggtatggccatgcatgcat

SEQ ID NO: 1131 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacatcagccccagcattttggtgatgggactcgactctccatcctaggtaagttgcagaatcagggtggtatggccatgcatgcat

SEQ ID NO: 1132 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacatcagccccagcattttggtgatgggactcgactctccatcctaggtaagttgcagaatcagggtggtatggccatgcatgcat

SEQ ID NO: 1133 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacatcagccccagcattttggtgatgggactcgactctccatcctaggtaagttgcagaatcagggtggtatggccatgcatgcat

SEQ ID NO: 1134 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacatcagccccagcattttggtgatgggactcgactctccatcctaggtaagttgcagaatcagggtggtatggccatgcatgcat

SEQ ID NO: 1135 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacatcagccccagcattttggtgatgggactcgactctccatcctaggtaagttgcagaatcagggtggtatggccatgcatgcat

SEQ ID NO: 1136 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacatcagccccagcattttggtgatgggactcgactctccatcctaggtaagttgcagaatcagggtggtatggccatgcatgcat

SEQ ID NO: 1137 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacataattcacccctccactttgggaacgggaccaggctcactgtgacaggtatgggggctccactcttgactcgggggcatgcat

SEQ ID NO: 1138 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacataattcacccctccactttgggaacgggaccaggctcactgtgacaggtatgggggctccactcttgactcgggggcatgcat

SEQ ID NO: 1139 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacataattcacccctccactttgggaacgggaccaggctcactgtgacaggtatgggggctccactcttgactcgggggcatgcat

SEQ ID NO: 1140 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacataattcacccctccactttgggaacgggaccaggctcactgtgacaggtatgggggctccactcttgactcgggggcatgcat

SEQ ID NO: 1141 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacataattcacccctccactttgggaacgggaccaggctcactgtgacaggtatgggggctccactcttgactcgggggcatgcat

SEQ ID NO: 1142 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacataattcacccctccactttgggaacgggaccaggctcactgtgacaggtatgggggctccactcttgactcgggggcatgcat

SEQ ID NO: 1143 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacataattcacccctccactttgggaacgggaccaggctcactgtgacaggtatgggggctccactcttgactcgggggcatgcat

SEQ ID NO: 1144 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacataattcacccctccactttgggaacgggaccaggctcactgtgacaggtatgggggctccactcttgactcgggggcatgcat

SEQ ID NO: 1145 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacataattcacccctccactttgggaacgggaccaggctcactgtgacaggtatgggggctccactcttgactcgggggcatgcat

SEQ ID NO: 1146 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacataattcacccctccactttgggaacgggaccaggctcactgtgacaggtatgggggctccactcttgactcgggggcatgcat

SEQ ID NO: 1147 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacataattcacccctccactttgggaacgggaccaggctcactgtgacaggtatgggggctccactcttgactcgggggcatgcat

SEQ ID NO: 1148 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacataattcacccctccactttgggaacgggaccaggctcactgtgacaggtatgggggctccactcttgactcgggggcatgcat

SEQ ID NO: 1149 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacataattcacccctccactttgggaacgggaccaggctcactgtgacaggtatgggggctccactcttgactcgggggcatgcat

SEQ ID NO: 1150 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacataattcacccctccactttgggaacgggaccaggctcactgtgacaggtatgggggctccactcttgactcgggggcatgcat

SEQ ID NO: 1151 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacataattcacccctccactttgggaacgggaccaggctcactgtgacaggtatgggggctccactcttgactcgggggcatgcat

SEQ ID NO: 1152 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacataattcacccctccactttgggaacgggaccaggctcactgtgacaggtatgggggctccactcttgactcgggggcatgcat

SEQ ID NO: 1153 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacataattcacccctccactttgggaacgggaccaggctcactgtgacaggtatgggggctccactcttgactcgggggcatgcat

SEQ ID NO: 1154 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacataattcacccctccactttgggaacgggaccaggctcactgtgacaggtatgggggctccactcttgactcgggggcatgcat

SEQ ID NO: 1155 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacataattcacccctccactttgggaacgggaccaggctcactgtgacaggtatgggggctccactcttgactcgggggcatgcat

SEQ ID NO: 1156 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacataattcacccctccactttgggaacgggaccaggctcactgtgacaggtatgggggctccactcttgactcgggggcatgcat

SEQ ID NO: 1157 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacataattcacccctccactttgggaacgggaccaggctcactgtgacaggtatgggggctccactcttgactcgggggcatgcat

SEQ ID NO: 1158 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacataattcacccctccactttgggaacgggaccaggctcactgtgacaggtatgggggctccactcttgactcgggggcatgcat

SEQ ID NO: 1159 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacataattcacccctccactttgggaacgggaccaggctcactgtgacaggtatgggggctccactcttgactcgggggcatgcat

SEQ ID NO: 1160 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacataattcacccctccactttgggaacgggaccaggctcactgtgacaggtatgggggctccactcttgactcgggggcatgcat

SEQ ID NO: 1161 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacataattcacccctccactttgggaacgggaccaggctcactgtgacaggtatgggggctccactcttgactcgggggcatgcat

SEQ ID NO: 1162 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacataattcacccctccactttgggaacgggaccaggctcactgtgacaggtatgggggctccactcttgactcgggggcatgcat

SEQ ID NO: 1163 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacataattcacccctccactttgggaacgggaccaggctcactgtgacaggtatgggggctccactcttgactcgggggcatgcat

SEQ ID NO: 1164 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacataattcacccctccactttgggaacgggaccaggctcactgtgacaggtatgggggctccactcttgactcgggggcatgcat

SEQ ID NO: 1165 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacataattcacccctccactttgggaacgggaccaggctcactgtgacaggtatgggggctccactcttgactcgggggcatgcat

SEQ ID NO: 1166 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacataattcacccctccactttgggaacgggaccaggctcactgtgacaggtatgggggctccactcttgactcgggggcatgcat

SEQ ID NO: 1167 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacataattcacccctccactttgggaacgggaccaggctcactgtgacaggtatgggggctccactcttgactcgggggcatgcat

SEQ ID NO: 1168 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacataattcacccctccactttgggaacgggaccaggctcactgtgacaggtatgggggctccactcttgactcgggggcatgcat

SEQ ID NO: 1169 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacataattcacccctccactttgggaacgggaccaggctcactgtgacaggtatgggggctccactcttgactcgggggcatgcat

SEQ ID NO: 1170 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacataattcacccctccactttgggaacgggaccaggctcactgtgacaggtatgggggctccactcttgactcgggggcatgcat

SEQ ID NO: 1171 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacataattcacccctccactttgggaacgggaccaggctcactgtgacaggtatgggggctccactcttgactcgggggcatgcat

SEQ ID NO: 1172 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacataattcacccctccactttgggaacgggaccaggctcactgtgacaggtatgggggctccactcttgactcgggggcatgcat

SEQ ID NO: 1173 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacataattcacccctccactttgggaacgggaccaggctcactgtgacaggtatgggggctccactcttgactcgggggcatgcat

SEQ ID NO: 1174 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacataattcacccctccactttgggaacgggaccaggctcactgtgacaggtatgggggctccactcttgactcgggggcatgcat

SEQ ID NO: 1175 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacataattcacccctccactttgggaacgggaccaggctcactgtgacaggtatgggggctccactcttgactcgggggcatgcat

SEQ ID NO: 1176 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacataattcacccctccactttgggaacgggaccaggctcactgtgacaggtatgggggctccactcttgactcgggggcatgcat

SEQ ID NO: 1177 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacataattcacccctccactttgggaacgggaccaggctcactgtgacaggtatgggggctccactcttgactcgggggcatgcat

SEQ ID NO: 1178 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacataattcacccctccactttgggaacgggaccaggctcactgtgacaggtatgggggctccactcttgactcgggggcatgcat

SEQ ID NO: 1179 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacataattcacccctccactttgggaacgggaccaggctcactgtgacaggtatgggggctccactcttgactcgggggcatgcat

SEQ ID NO: 1180 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacataattcacccctccactttgggaacgggaccaggctcactgtgacaggtatgggggctccactcttgactcgggggcatgcat

SEQ ID NO: 1181 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacataattcacccctccactttgggaacgggaccaggctcactgtgacaggtatgggggctccactcttgactcgggggcatgcat

SEQ ID NO: 1182 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacataattcacccctccactttgggaacgggaccaggctcactgtgacaggtatgggggctccactcttgactcgggggcatgcat

SEQ ID NO: 1183 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacataattcacccctccactttgggaacgggaccaggctcactgtgacaggtatgggggctccactcttgactcgggggcatgcat

SEQ ID NO: 1184 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacataattcacccctccactttgggaacgggaccaggctcactgtgacaggtatgggggctccactcttgactcgggggcatgcat

SEQ ID NO: 1185 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacataattcacccctccactttgggaacgggaccaggctcactgtgacaggtatgggggctccactcttgactcgggggcatgcat

SEQ ID NO: 1186 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacataattcacccctccactttgggaacgggaccaggctcactgtgacaggtatgggggctccactcttgactcgggggcatgcat

SEQ ID NO: 1187 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacataattcacccctccactttgggaacgggaccaggctcactgtgacaggtatgggggctccactcttgactcgggggcatgcat

SEQ ID NO: 1188 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacataattcacccctccactttgggaacgggaccaggctcactgtgacaggtatgggggctccactcttgactcgggggcatgcat

SEQ ID NO: 1189 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacataattcacccctccactttgggaacgggaccaggctcactgtgacaggtatgggggctccactcttgactcgggggcatgcat

SEQ ID NO: 1190 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacacaatgagcagttcttcgggccagggacacggctcaccgtgctaggtaagaagggggctccaggtgggagagaggggcatgcat

SEQ ID NO: 1191 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacacaatgagcagttcttcgggccagggacacggctcaccgtgctaggtaagaagggggctccaggtgggagagaggggcatgcat

SEQ ID NO: 1192 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacacaatgagcagttcttcgggccagggacacggctcaccgtgctaggtaagaagggggctccaggtgggagagaggggcatgcat

SEQ ID NO: 1193 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacacaatgagcagttcttcgggccagggacacggctcaccgtgctaggtaagaagggggctccaggtgggagagaggggcatgcat

SEQ ID NO: 1194 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacacaatgagcagttcttcgggccagggacacggctcaccgtgctaggtaagaagggggctccaggtgggagagaggggcatgcat

SEQ ID NO: 1195 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacacaatgagcagttcttcgggccagggacacggctcaccgtgctaggtaagaagggggctccaggtgggagagaggggcatgcat

SEQ ID NO: 1196 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacacaatgagcagttcttcgggccagggacacggctcaccgtgctaggtaagaagggggctccaggtgggagagaggggcatgcat

SEQ ID NO: 1197 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacacaatgagcagttcttcgggccagggacacggctcaccgtgctaggtaagaagggggctccaggtgggagagaggggcatgcat

SEQ ID NO: 1198 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacacaatgagcagttcttcgggccagggacacggctcaccgtgctaggtaagaagggggctccaggtgggagagaggggcatgcat

SEQ ID NO: 1199 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacacaatgagcagttcttcgggccagggacacggctcaccgtgctaggtaagaagggggctccaggtgggagagaggggcatgcat

SEQ ID NO: 1200 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacacaatgagcagttcttcgggccagggacacggctcaccgtgctaggtaagaagggggctccaggtgggagagaggggcatgcat

SEQ ID NO: 1201 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacacaatgagcagttcttcgggccagggacacggctcaccgtgctaggtaagaagggggctccaggtgggagagaggggcatgcat

SEQ ID NO: 1202 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacacaatgagcagttcttcgggccagggacacggctcaccgtgctaggtaagaagggggctccaggtgggagagaggggcatgcat

SEQ ID NO: 1203 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacacaatgagcagttcttcgggccagggacacggctcaccgtgctaggtaagaagggggctccaggtgggagagaggggcatgcat

SEQ ID NO: 1204 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacacaatgagcagttcttcgggccagggacacggctcaccgtgctaggtaagaagggggctccaggtgggagagaggggcatgcat

SEQ ID NO: 1205 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacacaatgagcagttcttcgggccagggacacggctcaccgtgctaggtaagaagggggctccaggtgggagagaggggcatgcat

SEQ ID NO: 1206 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacacaatgagcagttcttcgggccagggacacggctcaccgtgctaggtaagaagggggctccaggtgggagagaggggcatgcat

SEQ ID NO: 1207 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacacaatgagcagttcttcgggccagggacacggctcaccgtgctaggtaagaagggggctccaggtgggagagaggggcatgcat

SEQ ID NO: 1208 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacacaatgagcagttcttcgggccagggacacggctcaccgtgctaggtaagaagggggctccaggtgggagagaggggcatgcat

SEQ ID NO: 1209 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacacaatgagcagttcttcgggccagggacacggctcaccgtgctaggtaagaagggggctccaggtgggagagaggggcatgcat

SEQ ID NO: 1210 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacacaatgagcagttcttcgggccagggacacggctcaccgtgctaggtaagaagggggctccaggtgggagagaggggcatgcat

SEQ ID NO: 1211 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacacaatgagcagttcttcgggccagggacacggctcaccgtgctaggtaagaagggggctccaggtgggagagaggggcatgcat

SEQ ID NO: 1212 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacacaatgagcagttcttcgggccagggacacggctcaccgtgctaggtaagaagggggctccaggtgggagagaggggcatgcat

SEQ ID NO: 1213 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacacaatgagcagttcttcgggccagggacacggctcaccgtgctaggtaagaagggggctccaggtgggagagaggggcatgcat

SEQ ID NO: 1214 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacacaatgagcagttcttcgggccagggacacggctcaccgtgctaggtaagaagggggctccaggtgggagagaggggcatgcat

SEQ ID NO: 1215 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacacaatgagcagttcttcgggccagggacacggctcaccgtgctaggtaagaagggggctccaggtgggagagaggggcatgcat

SEQ ID NO: 1216 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacacaatgagcagttcttcgggccagggacacggctcaccgtgctaggtaagaagggggctccaggtgggagagaggggcatgcat

SEQ ID NO: 1217 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacacaatgagcagttcttcgggccagggacacggctcaccgtgctaggtaagaagggggctccaggtgggagagaggggcatgcat

SEQ ID NO: 1218 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacacaatgagcagttcttcgggccagggacacggctcaccgtgctaggtaagaagggggctccaggtgggagagaggggcatgcat

SEQ ID NO: 1219 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacacaatgagcagttcttcgggccagggacacggctcaccgtgctaggtaagaagggggctccaggtgggagagaggggcatgcat

SEQ ID NO: 1220 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacacaatgagcagttcttcgggccagggacacggctcaccgtgctaggtaagaagggggctccaggtgggagagaggggcatgcat

SEQ ID NO: 1221 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacacaatgagcagttcttcgggccagggacacggctcaccgtgctaggtaagaagggggctccaggtgggagagaggggcatgcat

SEQ ID NO: 1222 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacacaatgagcagttcttcgggccagggacacggctcaccgtgctaggtaagaagggggctccaggtgggagagaggggcatgcat

SEQ ID NO: 1223 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacacaatgagcagttcttcgggccagggacacggctcaccgtgctaggtaagaagggggctccaggtgggagagaggggcatgcat

SEQ ID NO: 1224 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacacaatgagcagttcttcgggccagggacacggctcaccgtgctaggtaagaagggggctccaggtgggagagaggggcatgcat

SEQ ID NO: 1225 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacacaatgagcagttcttcgggccagggacacggctcaccgtgctaggtaagaagggggctccaggtgggagagaggggcatgcat

SEQ ID NO: 1226 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacacaatgagcagttcttcgggccagggacacggctcaccgtgctaggtaagaagggggctccaggtgggagagaggggcatgcat

SEQ ID NO: 1227 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacacaatgagcagttcttcgggccagggacacggctcaccgtgctaggtaagaagggggctccaggtgggagagaggggcatgcat

SEQ ID NO: 1228 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacacaatgagcagttcttcgggccagggacacggctcaccgtgctaggtaagaagggggctccaggtgggagagaggggcatgcat

SEQ ID NO: 1229 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacacaatgagcagttcttcgggccagggacacggctcaccgtgctaggtaagaagggggctccaggtgggagagaggggcatgcat

SEQ ID NO: 1230 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacacaatgagcagttcttcgggccagggacacggctcaccgtgctaggtaagaagggggctccaggtgggagagaggggcatgcat

SEQ ID NO: 1231 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacacaatgagcagttcttcgggccagggacacggctcaccgtgctaggtaagaagggggctccaggtgggagagaggggcatgcat

SEQ ID NO: 1232 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacacaatgagcagttcttcgggccagggacacggctcaccgtgctaggtaagaagggggctccaggtgggagagaggggcatgcat

SEQ ID NO: 1233 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacacaatgagcagttcttcgggccagggacacggctcaccgtgctaggtaagaagggggctccaggtgggagagaggggcatgcat

SEQ ID NO: 1234 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacacaatgagcagttcttcgggccagggacacggctcaccgtgctaggtaagaagggggctccaggtgggagagaggggcatgcat

SEQ ID NO: 1235 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacacaatgagcagttcttcgggccagggacacggctcaccgtgctaggtaagaagggggctccaggtgggagagaggggcatgcat

SEQ ID NO: 1236 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacacaatgagcagttcttcgggccagggacacggctcaccgtgctaggtaagaagggggctccaggtgggagagaggggcatgcat

SEQ ID NO: 1237 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacacaatgagcagttcttcgggccagggacacggctcaccgtgctaggtaagaagggggctccaggtgggagagaggggcatgcat

SEQ ID NO: 1238 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacacaatgagcagttcttcgggccagggacacggctcaccgtgctaggtaagaagggggctccaggtgggagagaggggcatgcat

SEQ ID NO: 1239 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacacaatgagcagttcttcgggccagggacacggctcaccgtgctaggtaagaagggggctccaggtgggagagaggggcatgcat

SEQ ID NO: 1240 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacacaatgagcagttcttcgggccagggacacggctcaccgtgctaggtaagaagggggctccaggtgggagagaggggcatgcat

SEQ ID NO: 1241 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacacaatgagcagttcttcgggccagggacacggctcaccgtgctaggtaagaagggggctccaggtgggagagaggggcatgcat

SEQ ID NO: 1242 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacacaatgagcagttcttcgggccagggacacggctcaccgtgctaggtaagaagggggctccaggtgggagagaggggcatgcat

SEQ ID NO: 1243 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaccggggagctgttttttggagaaggctctaggctgaccgtactgggtaaggaggcggttggggctccggagagctgcatgcat

SEQ ID NO: 1244 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaccggggagctgttttttggagaaggctctaggctgaccgtactgggtaaggaggcggttggggctccggagagctgcatgcat

SEQ ID NO: 1245 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaccggggagctgttttttggagaaggctctaggctgaccgtactgggtaaggaggcggttggggctccggagagctgcatgcat

SEQ ID NO: 1246 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaccggggagctgttttttggagaaggctctaggctgaccgtactgggtaaggaggcggttggggctccggagagctgcatgcat

SEQ ID NO: 1247 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaccggggagctgttttttggagaaggctctaggctgaccgtactgggtaaggaggcggttggggctccggagagctgcatgcat

SEQ ID NO: 1248 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaccggggagctgttttttggagaaggctctaggctgaccgtactgggtaaggaggcggttggggctccggagagctgcatgcat

SEQ ID NO: 1249 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaccggggagctgttttttggagaaggctctaggctgaccgtactgggtaaggaggcggttggggctccggagagctgcatgcat

SEQ ID NO: 1250 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaccggggagctgttttttggagaaggctctaggctgaccgtactgggtaaggaggcggttggggctccggagagctgcatgcat

SEQ ID NO: 1251 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaccggggagctgttttttggagaaggctctaggctgaccgtactgggtaaggaggcggttggggctccggagagctgcatgcat

SEQ ID NO: 1252 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaccggggagctgttttttggagaaggctctaggctgaccgtactgggtaaggaggcggttggggctccggagagctgcatgcat

SEQ ID NO: 1253 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaccggggagctgttttttggagaaggctctaggctgaccgtactgggtaaggaggcggttggggctccggagagctgcatgcat

SEQ ID NO: 1254 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaccggggagctgttttttggagaaggctctaggctgaccgtactgggtaaggaggcggttggggctccggagagctgcatgcat

SEQ ID NO: 1255 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaccggggagctgttttttggagaaggctctaggctgaccgtactgggtaaggaggcggttggggctccggagagctgcatgcat

SEQ ID NO: 1256 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaccggggagctgttttttggagaaggctctaggctgaccgtactgggtaaggaggcggttggggctccggagagctgcatgcat

SEQ ID NO: 1257 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaccggggagctgttttttggagaaggctctaggctgaccgtactgggtaaggaggcggttggggctccggagagctgcatgcat

SEQ ID NO: 1258 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaccggggagctgttttttggagaaggctctaggctgaccgtactgggtaaggaggcggttggggctccggagagctgcatgcat

SEQ ID NO: 1259 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaccggggagctgttttttggagaaggctctaggctgaccgtactgggtaaggaggcggttggggctccggagagctgcatgcat

SEQ ID NO: 1260 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaccggggagctgttttttggagaaggctctaggctgaccgtactgggtaaggaggcggttggggctccggagagctgcatgcat

SEQ ID NO: 1261 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaccggggagctgttttttggagaaggctctaggctgaccgtactgggtaaggaggcggttggggctccggagagctgcatgcat

SEQ ID NO: 1262 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaccggggagctgttttttggagaaggctctaggctgaccgtactgggtaaggaggcggttggggctccggagagctgcatgcat

SEQ ID NO: 1263 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaccggggagctgttttttggagaaggctctaggctgaccgtactgggtaaggaggcggttggggctccggagagctgcatgcat

SEQ ID NO: 1264 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaccggggagctgttttttggagaaggctctaggctgaccgtactgggtaaggaggcggttggggctccggagagctgcatgcat

SEQ ID NO: 1265 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaccggggagctgttttttggagaaggctctaggctgaccgtactgggtaaggaggcggttggggctccggagagctgcatgcat

SEQ ID NO: 1266 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaccggggagctgttttttggagaaggctctaggctgaccgtactgggtaaggaggcggttggggctccggagagctgcatgcat

SEQ ID NO: 1267 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaccggggagctgttttttggagaaggctctaggctgaccgtactgggtaaggaggcggttggggctccggagagctgcatgcat

SEQ ID NO: 1268 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaccggggagctgttttttggagaaggctctaggctgaccgtactgggtaaggaggcggttggggctccggagagctgcatgcat

SEQ ID NO: 1269 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaccggggagctgttttttggagaaggctctaggctgaccgtactgggtaaggaggcggttggggctccggagagctgcatgcat

SEQ ID NO: 1270 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaccggggagctgttttttggagaaggctctaggctgaccgtactgggtaaggaggcggttggggctccggagagctgcatgcat

SEQ ID NO: 1271 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaccggggagctgttttttggagaaggctctaggctgaccgtactgggtaaggaggcggttggggctccggagagctgcatgcat

SEQ ID NO: 1272 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaccggggagctgttttttggagaaggctctaggctgaccgtactgggtaaggaggcggttggggctccggagagctgcatgcat

SEQ ID NO: 1273 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaccggggagctgttttttggagaaggctctaggctgaccgtactgggtaaggaggcggttggggctccggagagctgcatgcat

SEQ ID NO: 1274 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaccggggagctgttttttggagaaggctctaggctgaccgtactgggtaaggaggcggttggggctccggagagctgcatgcat

SEQ ID NO: 1275 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaccggggagctgttttttggagaaggctctaggctgaccgtactgggtaaggaggcggttggggctccggagagctgcatgcat

SEQ ID NO: 1276 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaccggggagctgttttttggagaaggctctaggctgaccgtactgggtaaggaggcggttggggctccggagagctgcatgcat

SEQ ID NO: 1277 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaccggggagctgttttttggagaaggctctaggctgaccgtactgggtaaggaggcggttggggctccggagagctgcatgcat

SEQ ID NO: 1278 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaccggggagctgttttttggagaaggctctaggctgaccgtactgggtaaggaggcggttggggctccggagagctgcatgcat

SEQ ID NO: 1279 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaccggggagctgttttttggagaaggctctaggctgaccgtactgggtaaggaggcggttggggctccggagagctgcatgcat

SEQ ID NO: 1280 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaccggggagctgttttttggagaaggctctaggctgaccgtactgggtaaggaggcggttggggctccggagagctgcatgcat

SEQ ID NO: 1281 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaccggggagctgttttttggagaaggctctaggctgaccgtactgggtaaggaggcggttggggctccggagagctgcatgcat

SEQ ID NO: 1282 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaccggggagctgttttttggagaaggctctaggctgaccgtactgggtaaggaggcggttggggctccggagagctgcatgcat

SEQ ID NO: 1283 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaccggggagctgttttttggagaaggctctaggctgaccgtactgggtaaggaggcggttggggctccggagagctgcatgcat

SEQ ID NO: 1284 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaccggggagctgttttttggagaaggctctaggctgaccgtactgggtaaggaggcggttggggctccggagagctgcatgcat

SEQ ID NO: 1285 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaccggggagctgttttttggagaaggctctaggctgaccgtactgggtaaggaggcggttggggctccggagagctgcatgcat

SEQ ID NO: 1286 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaccggggagctgttttttggagaaggctctaggctgaccgtactgggtaaggaggcggttggggctccggagagctgcatgcat

SEQ ID NO: 1287 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaccggggagctgttttttggagaaggctctaggctgaccgtactgggtaaggaggcggttggggctccggagagctgcatgcat

SEQ ID NO: 1288 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaccggggagctgttttttggagaaggctctaggctgaccgtactgggtaaggaggcggttggggctccggagagctgcatgcat

SEQ ID NO: 1289 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaccggggagctgttttttggagaaggctctaggctgaccgtactgggtaaggaggcggttggggctccggagagctgcatgcat

SEQ ID NO: 1290 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaccggggagctgttttttggagaaggctctaggctgaccgtactgggtaaggaggcggttggggctccggagagctgcatgcat

SEQ ID NO: 1291 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaccggggagctgttttttggagaaggctctaggctgaccgtactgggtaaggaggcggttggggctccggagagctgcatgcat

SEQ ID NO: 1292 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaccggggagctgttttttggagaaggctctaggctgaccgtactgggtaaggaggcggttggggctccggagagctgcatgcat

SEQ ID NO: 1293 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaccggggagctgttttttggagaaggctctaggctgaccgtactgggtaaggaggcggttggggctccggagagctgcatgcat

SEQ ID NO: 1294 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaccggggagctgttttttggagaaggctctaggctgaccgtactgggtaaggaggcggttggggctccggagagctgcatgcat

SEQ ID NO: 1295 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaccggggagctgttttttggagaaggctctaggctgaccgtactgggtaaggaggcggttggggctccggagagctgcatgcat

SEQ ID NO: 1296 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacagatacgcagtattttggcccaggcacccggctgacagtgctcggtaagcgggggctcccgctgaagccccggaacgcatgcat

SEQ ID NO: 1297 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacagatacgcagtattttggcccaggcacccggctgacagtgctcggtaagcgggggctcccgctgaagccccggaacgcatgcat

SEQ ID NO: 1298 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacagatacgcagtattttggcccaggcacccggctgacagtgctcggtaagcgggggctcccgctgaagccccggaacgcatgcat

SEQ ID NO: 1299 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacagatacgcagtattttggcccaggcacccggctgacagtgctcggtaagcgggggctcccgctgaagccccggaacgcatgcat

SEQ ID NO: 1300 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacagatacgcagtattttggcccaggcacccggctgacagtgctcggtaagcgggggctcccgctgaagccccggaacgcatgcat

SEQ ID NO: 1301 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacagatacgcagtattttggcccaggcacccggctgacagtgctcggtaagcgggggctcccgctgaagccccggaacgcatgcat

SEQ ID NO: 1302 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacagatacgcagtattttggcccaggcacccggctgacagtgctcggtaagcgggggctcccgctgaagccccggaacgcatgcat

SEQ ID NO: 1303 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacagatacgcagtattttggcccaggcacccggctgacagtgctcggtaagcgggggctcccgctgaagccccggaacgcatgcat

SEQ ID NO: 1304 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacagatacgcagtattttggcccaggcacccggctgacagtgctcggtaagcgggggctcccgctgaagccccggaacgcatgcat

SEQ ID NO: 1305 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacagatacgcagtattttggcccaggcacccggctgacagtgctcggtaagcgggggctcccgctgaagccccggaacgcatgcat

SEQ ID NO: 1306 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacagatacgcagtattttggcccaggcacccggctgacagtgctcggtaagcgggggctcccgctgaagccccggaacgcatgcat

SEQ ID NO: 1307 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacagatacgcagtattttggcccaggcacccggctgacagtgctcggtaagcgggggctcccgctgaagccccggaacgcatgcat

SEQ ID NO: 1308 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacagatacgcagtattttggcccaggcacccggctgacagtgctcggtaagcgggggctcccgctgaagccccggaacgcatgcat

SEQ ID NO: 1309 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacagatacgcagtattttggcccaggcacccggctgacagtgctcggtaagcgggggctcccgctgaagccccggaacgcatgcat

SEQ ID NO: 1310 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacagatacgcagtattttggcccaggcacccggctgacagtgctcggtaagcgggggctcccgctgaagccccggaacgcatgcat

SEQ ID NO: 1311 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacagatacgcagtattttggcccaggcacccggctgacagtgctcggtaagcgggggctcccgctgaagccccggaacgcatgcat

SEQ ID NO: 1312 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacagatacgcagtattttggcccaggcacccggctgacagtgctcggtaagcgggggctcccgctgaagccccggaacgcatgcat

SEQ ID NO: 1313 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacagatacgcagtattttggcccaggcacccggctgacagtgctcggtaagcgggggctcccgctgaagccccggaacgcatgcat

SEQ ID NO: 1314 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacagatacgcagtattttggcccaggcacccggctgacagtgctcggtaagcgggggctcccgctgaagccccggaacgcatgcat

SEQ ID NO: 1315 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacagatacgcagtattttggcccaggcacccggctgacagtgctcggtaagcgggggctcccgctgaagccccggaacgcatgcat

SEQ ID NO: 1316 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacagatacgcagtattttggcccaggcacccggctgacagtgctcggtaagcgggggctcccgctgaagccccggaacgcatgcat

SEQ ID NO: 1317 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacagatacgcagtattttggcccaggcacccggctgacagtgctcggtaagcgggggctcccgctgaagccccggaacgcatgcat

SEQ ID NO: 1318 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacagatacgcagtattttggcccaggcacccggctgacagtgctcggtaagcgggggctcccgctgaagccccggaacgcatgcat

SEQ ID NO: 1319 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacagatacgcagtattttggcccaggcacccggctgacagtgctcggtaagcgggggctcccgctgaagccccggaacgcatgcat

SEQ ID NO: 1320 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacagatacgcagtattttggcccaggcacccggctgacagtgctcggtaagcgggggctcccgctgaagccccggaacgcatgcat

SEQ ID NO: 1321 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacagatacgcagtattttggcccaggcacccggctgacagtgctcggtaagcgggggctcccgctgaagccccggaacgcatgcat

SEQ ID NO: 1322 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacagatacgcagtattttggcccaggcacccggctgacagtgctcggtaagcgggggctcccgctgaagccccggaacgcatgcat

SEQ ID NO: 1323 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacagatacgcagtattttggcccaggcacccggctgacagtgctcggtaagcgggggctcccgctgaagccccggaacgcatgcat

SEQ ID NO: 1324 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacagatacgcagtattttggcccaggcacccggctgacagtgctcggtaagcgggggctcccgctgaagccccggaacgcatgcat

SEQ ID NO: 1325 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacagatacgcagtattttggcccaggcacccggctgacagtgctcggtaagcgggggctcccgctgaagccccggaacgcatgcat

SEQ ID NO: 1326 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacagatacgcagtattttggcccaggcacccggctgacagtgctcggtaagcgggggctcccgctgaagccccggaacgcatgcat

SEQ ID NO: 1327 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacagatacgcagtattttggcccaggcacccggctgacagtgctcggtaagcgggggctcccgctgaagccccggaacgcatgcat

SEQ ID NO: 1328 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacagatacgcagtattttggcccaggcacccggctgacagtgctcggtaagcgggggctcccgctgaagccccggaacgcatgcat

SEQ ID NO: 1329 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacagatacgcagtattttggcccaggcacccggctgacagtgctcggtaagcgggggctcccgctgaagccccggaacgcatgcat

SEQ ID NO: 1330 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacagatacgcagtattttggcccaggcacccggctgacagtgctcggtaagcgggggctcccgctgaagccccggaacgcatgcat

SEQ ID NO: 1331 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacagatacgcagtattttggcccaggcacccggctgacagtgctcggtaagcgggggctcccgctgaagccccggaacgcatgcat

SEQ ID NO: 1332 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacagatacgcagtattttggcccaggcacccggctgacagtgctcggtaagcgggggctcccgctgaagccccggaacgcatgcat

SEQ ID NO: 1333 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacagatacgcagtattttggcccaggcacccggctgacagtgctcggtaagcgggggctcccgctgaagccccggaacgcatgcat

SEQ ID NO: 1334 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacagatacgcagtattttggcccaggcacccggctgacagtgctcggtaagcgggggctcccgctgaagccccggaacgcatgcat

SEQ ID NO: 1335 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacagatacgcagtattttggcccaggcacccggctgacagtgctcggtaagcgggggctcccgctgaagccccggaacgcatgcat

SEQ ID NO: 1336 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacagatacgcagtattttggcccaggcacccggctgacagtgctcggtaagcgggggctcccgctgaagccccggaacgcatgcat

SEQ ID NO: 1337 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacagatacgcagtattttggcccaggcacccggctgacagtgctcggtaagcgggggctcccgctgaagccccggaacgcatgcat

SEQ ID NO: 1338 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacagatacgcagtattttggcccaggcacccggctgacagtgctcggtaagcgggggctcccgctgaagccccggaacgcatgcat

SEQ ID NO: 1339 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacagatacgcagtattttggcccaggcacccggctgacagtgctcggtaagcgggggctcccgctgaagccccggaacgcatgcat

SEQ ID NO: 1340 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacagatacgcagtattttggcccaggcacccggctgacagtgctcggtaagcgggggctcccgctgaagccccggaacgcatgcat

SEQ ID NO: 1341 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacagatacgcagtattttggcccaggcacccggctgacagtgctcggtaagcgggggctcccgctgaagccccggaacgcatgcat

SEQ ID NO: 1342 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacagatacgcagtattttggcccaggcacccggctgacagtgctcggtaagcgggggctcccgctgaagccccggaacgcatgcat

SEQ ID NO: 1343 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacagatacgcagtattttggcccaggcacccggctgacagtgctcggtaagcgggggctcccgctgaagccccggaacgcatgcat

SEQ ID NO: 1344 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacagatacgcagtattttggcccaggcacccggctgacagtgctcggtaagcgggggctcccgctgaagccccggaacgcatgcat

SEQ ID NO: 1345 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacagatacgcagtattttggcccaggcacccggctgacagtgctcggtaagcgggggctcccgctgaagccccggaacgcatgcat

SEQ ID NO: 1346 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacagatacgcagtattttggcccaggcacccggctgacagtgctcggtaagcgggggctcccgctgaagccccggaacgcatgcat

SEQ ID NO: 1347 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacagatacgcagtattttggcccaggcacccggctgacagtgctcggtaagcgggggctcccgctgaagccccggaacgcatgcat

SEQ ID NO: 1348 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacagatacgcagtattttggcccaggcacccggctgacagtgctcggtaagcgggggctcccgctgaagccccggaacgcatgcat

SEQ ID NO: 1349 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaaaacattcagtacttcggcgccgggacccggctctcagtgctgggtaagctggggccgccgggggaccggggacggcatgcat

SEQ ID NO: 1350 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaaaacattcagtacttcggcgccgggacccggctctcagtgctgggtaagctggggccgccgggggaccggggacggcatgcat

SEQ ID NO: 1351 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaaaacattcagtacttcggcgccgggacccggctctcagtgctgggtaagctggggccgccgggggaccggggacggcatgcat

SEQ ID NO: 1352 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaaaacattcagtacttcggcgccgggacccggctctcagtgctgggtaagctggggccgccgggggaccggggacggcatgcat

SEQ ID NO: 1353 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaaaacattcagtacttcggcgccgggacccggctctcagtgctgggtaagctggggccgccgggggaccggggacggcatgcat

SEQ ID NO: 1354 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaaaacattcagtacttcggcgccgggacccggctctcagtgctgggtaagctggggccgccgggggaccggggacggcatgcat

SEQ ID NO: 1355 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaaaacattcagtacttcggcgccgggacccggctctcagtgctgggtaagctggggccgccgggggaccggggacggcatgcat

SEQ ID NO: 1356 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaaaacattcagtacttcggcgccgggacccggctctcagtgctgggtaagctggggccgccgggggaccggggacggcatgcat

SEQ ID NO: 1357 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaaaacattcagtacttcggcgccgggacccggctctcagtgctgggtaagctggggccgccgggggaccggggacggcatgcat

SEQ ID NO: 1358 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaaaacattcagtacttcggcgccgggacccggctctcagtgctgggtaagctggggccgccgggggaccggggacggcatgcat

SEQ ID NO: 1359 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaaaacattcagtacttcggcgccgggacccggctctcagtgctgggtaagctggggccgccgggggaccggggacggcatgcat

SEQ ID NO: 1360 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaaaacattcagtacttcggcgccgggacccggctctcagtgctgggtaagctggggccgccgggggaccggggacggcatgcat

SEQ ID NO: 1361 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaaaacattcagtacttcggcgccgggacccggctctcagtgctgggtaagctggggccgccgggggaccggggacggcatgcat

SEQ ID NO: 1362 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaaaacattcagtacttcggcgccgggacccggctctcagtgctgggtaagctggggccgccgggggaccggggacggcatgcat

SEQ ID NO: 1363 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaaaacattcagtacttcggcgccgggacccggctctcagtgctgggtaagctggggccgccgggggaccggggacggcatgcat

SEQ ID NO: 1364 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaaaacattcagtacttcggcgccgggacccggctctcagtgctgggtaagctggggccgccgggggaccggggacggcatgcat

SEQ ID NO: 1365 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaaaacattcagtacttcggcgccgggacccggctctcagtgctgggtaagctggggccgccgggggaccggggacggcatgcat

SEQ ID NO: 1366 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaaaacattcagtacttcggcgccgggacccggctctcagtgctgggtaagctggggccgccgggggaccggggacggcatgcat

SEQ ID NO: 1367 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaaaacattcagtacttcggcgccgggacccggctctcagtgctgggtaagctggggccgccgggggaccggggacggcatgcat

SEQ ID NO: 1368 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaaaacattcagtacttcggcgccgggacccggctctcagtgctgggtaagctggggccgccgggggaccggggacggcatgcat

SEQ ID NO: 1369 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaaaacattcagtacttcggcgccgggacccggctctcagtgctgggtaagctggggccgccgggggaccggggacggcatgcat

SEQ ID NO: 1370 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaaaacattcagtacttcggcgccgggacccggctctcagtgctgggtaagctggggccgccgggggaccggggacggcatgcat

SEQ ID NO: 1371 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaaaacattcagtacttcggcgccgggacccggctctcagtgctgggtaagctggggccgccgggggaccggggacggcatgcat

SEQ ID NO: 1372 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaaaacattcagtacttcggcgccgggacccggctctcagtgctgggtaagctggggccgccgggggaccggggacggcatgcat

SEQ ID NO: 1373 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaaaacattcagtacttcggcgccgggacccggctctcagtgctgggtaagctggggccgccgggggaccggggacggcatgcat

SEQ ID NO: 1374 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaaaacattcagtacttcggcgccgggacccggctctcagtgctgggtaagctggggccgccgggggaccggggacggcatgcat

SEQ ID NO: 1375 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaaaacattcagtacttcggcgccgggacccggctctcagtgctgggtaagctggggccgccgggggaccggggacggcatgcat

SEQ ID NO: 1376 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaaaacattcagtacttcggcgccgggacccggctctcagtgctgggtaagctggggccgccgggggaccggggacggcatgcat

SEQ ID NO: 1377 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaaaacattcagtacttcggcgccgggacccggctctcagtgctgggtaagctggggccgccgggggaccggggacggcatgcat

SEQ ID NO: 1378 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaaaacattcagtacttcggcgccgggacccggctctcagtgctgggtaagctggggccgccgggggaccggggacggcatgcat

SEQ ID NO: 1379 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaaaacattcagtacttcggcgccgggacccggctctcagtgctgggtaagctggggccgccgggggaccggggacggcatgcat

SEQ ID NO: 1380 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaaaacattcagtacttcggcgccgggacccggctctcagtgctgggtaagctggggccgccgggggaccggggacggcatgcat

SEQ ID NO: 1381 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaaaacattcagtacttcggcgccgggacccggctctcagtgctgggtaagctggggccgccgggggaccggggacggcatgcat

SEQ ID NO: 1382 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaaaacattcagtacttcggcgccgggacccggctctcagtgctgggtaagctggggccgccgggggaccggggacggcatgcat

SEQ ID NO: 1383 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaaaacattcagtacttcggcgccgggacccggctctcagtgctgggtaagctggggccgccgggggaccggggacggcatgcat

SEQ ID NO: 1384 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaaaacattcagtacttcggcgccgggacccggctctcagtgctgggtaagctggggccgccgggggaccggggacggcatgcat

SEQ ID NO: 1385 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaaaacattcagtacttcggcgccgggacccggctctcagtgctgggtaagctggggccgccgggggaccggggacggcatgcat

SEQ ID NO: 1386 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaaaacattcagtacttcggcgccgggacccggctctcagtgctgggtaagctggggccgccgggggaccggggacggcatgcat

SEQ ID NO: 1387 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaaaacattcagtacttcggcgccgggacccggctctcagtgctgggtaagctggggccgccgggggaccggggacggcatgcat

SEQ ID NO: 1388 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaaaacattcagtacttcggcgccgggacccggctctcagtgctgggtaagctggggccgccgggggaccggggacggcatgcat

SEQ ID NO: 1389 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaaaacattcagtacttcggcgccgggacccggctctcagtgctgggtaagctggggccgccgggggaccggggacggcatgcat

SEQ ID NO: 1390 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaaaacattcagtacttcggcgccgggacccggctctcagtgctgggtaagctggggccgccgggggaccggggacggcatgcat

SEQ ID NO: 1391 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaaaacattcagtacttcggcgccgggacccggctctcagtgctgggtaagctggggccgccgggggaccggggacggcatgcat

SEQ ID NO: 1392 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaaaacattcagtacttcggcgccgggacccggctctcagtgctgggtaagctggggccgccgggggaccggggacggcatgcat

SEQ ID NO: 1393 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaaaacattcagtacttcggcgccgggacccggctctcagtgctgggtaagctggggccgccgggggaccggggacggcatgcat

SEQ ID NO: 1394 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaaaacattcagtacttcggcgccgggacccggctctcagtgctgggtaagctggggccgccgggggaccggggacggcatgcat

SEQ ID NO: 1395 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaaaacattcagtacttcggcgccgggacccggctctcagtgctgggtaagctggggccgccgggggaccggggacggcatgcat

SEQ ID NO: 1396 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaaaacattcagtacttcggcgccgggacccggctctcagtgctgggtaagctggggccgccgggggaccggggacggcatgcat

SEQ ID NO: 1397 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaaaacattcagtacttcggcgccgggacccggctctcagtgctgggtaagctggggccgccgggggaccggggacggcatgcat

SEQ ID NO: 1398 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaaaacattcagtacttcggcgccgggacccggctctcagtgctgggtaagctggggccgccgggggaccggggacggcatgcat

SEQ ID NO: 1399 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaaaacattcagtacttcggcgccgggacccggctctcagtgctgggtaagctggggccgccgggggaccggggacggcatgcat

SEQ ID NO: 1400 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaaaacattcagtacttcggcgccgggacccggctctcagtgctgggtaagctggggccgccgggggaccggggacggcatgcat

SEQ ID NO: 1401 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaaaacattcagtacttcggcgccgggacccggctctcagtgctgggtaagctggggccgccgggggaccggggacggcatgcat

SEQ ID NO: 1402 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgagacccagtacttcgggccaggcacgcggctcctggtgctcggtgagcgcgggctgctggggcgcgggcgcgggcgcatgcat

SEQ ID NO: 1403 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgagacccagtacttcgggccaggcacgcggctcctggtgctcggtgagcgcgggctgctggggcgcgggcgcgggcgcatgcat

SEQ ID NO: 1404 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgagacccagtacttcgggccaggcacgcggctcctggtgctcggtgagcgcgggctgctggggcgcgggcgcgggcgcatgcat

SEQ ID NO: 1405 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgagacccagtacttcgggccaggcacgcggctcctggtgctcggtgagcgcgggctgctggggcgcgggcgcgggcgcatgcat

SEQ ID NO: 1406 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgagacccagtacttcgggccaggcacgcggctcctggtgctcggtgagcgcgggctgctggggcgcgggcgcgggcgcatgcat

SEQ ID NO: 1407 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgagacccagtacttcgggccaggcacgcggctcctggtgctcggtgagcgcgggctgctggggcgcgggcgcgggcgcatgcat

SEQ ID NO: 1408 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgagacccagtacttcgggccaggcacgcggctcctggtgctcggtgagcgcgggctgctggggcgcgggcgcgggcgcatgcat

SEQ ID NO: 1409 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgagacccagtacttcgggccaggcacgcggctcctggtgctcggtgagcgcgggctgctggggcgcgggcgcgggcgcatgcat

SEQ ID NO: 1410 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgagacccagtacttcgggccaggcacgcggctcctggtgctcggtgagcgcgggctgctggggcgcgggcgcgggcgcatgcat

SEQ ID NO: 1411 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgagacccagtacttcgggccaggcacgcggctcctggtgctcggtgagcgcgggctgctggggcgcgggcgcgggcgcatgcat

SEQ ID NO: 1412 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgagacccagtacttcgggccaggcacgcggctcctggtgctcggtgagcgcgggctgctggggcgcgggcgcgggcgcatgcat

SEQ ID NO: 1413 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgagacccagtacttcgggccaggcacgcggctcctggtgctcggtgagcgcgggctgctggggcgcgggcgcgggcgcatgcat

SEQ ID NO: 1414 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgagacccagtacttcgggccaggcacgcggctcctggtgctcggtgagcgcgggctgctggggcgcgggcgcgggcgcatgcat

SEQ ID NO: 1415 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgagacccagtacttcgggccaggcacgcggctcctggtgctcggtgagcgcgggctgctggggcgcgggcgcgggcgcatgcat

SEQ ID NO: 1416 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgagacccagtacttcgggccaggcacgcggctcctggtgctcggtgagcgcgggctgctggggcgcgggcgcgggcgcatgcat

SEQ ID NO: 1417 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgagacccagtacttcgggccaggcacgcggctcctggtgctcggtgagcgcgggctgctggggcgcgggcgcgggcgcatgcat

SEQ ID NO: 1418 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgagacccagtacttcgggccaggcacgcggctcctggtgctcggtgagcgcgggctgctggggcgcgggcgcgggcgcatgcat

SEQ ID NO: 1419 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgagacccagtacttcgggccaggcacgcggctcctggtgctcggtgagcgcgggctgctggggcgcgggcgcgggcgcatgcat

SEQ ID NO: 1420 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgagacccagtacttcgggccaggcacgcggctcctggtgctcggtgagcgcgggctgctggggcgcgggcgcgggcgcatgcat

SEQ ID NO: 1421 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgagacccagtacttcgggccaggcacgcggctcctggtgctcggtgagcgcgggctgctggggcgcgggcgcgggcgcatgcat

SEQ ID NO: 1422 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgagacccagtacttcgggccaggcacgcggctcctggtgctcggtgagcgcgggctgctggggcgcgggcgcgggcgcatgcat

SEQ ID NO: 1423 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgagacccagtacttcgggccaggcacgcggctcctggtgctcggtgagcgcgggctgctggggcgcgggcgcgggcgcatgcat

SEQ ID NO: 1424 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgagacccagtacttcgggccaggcacgcggctcctggtgctcggtgagcgcgggctgctggggcgcgggcgcgggcgcatgcat

SEQ ID NO: 1425 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgagacccagtacttcgggccaggcacgcggctcctggtgctcggtgagcgcgggctgctggggcgcgggcgcgggcgcatgcat

SEQ ID NO: 1426 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgagacccagtacttcgggccaggcacgcggctcctggtgctcggtgagcgcgggctgctggggcgcgggcgcgggcgcatgcat

SEQ ID NO: 1427 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgagacccagtacttcgggccaggcacgcggctcctggtgctcggtgagcgcgggctgctggggcgcgggcgcgggcgcatgcat

SEQ ID NO: 1428 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgagacccagtacttcgggccaggcacgcggctcctggtgctcggtgagcgcgggctgctggggcgcgggcgcgggcgcatgcat

SEQ ID NO: 1429 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgagacccagtacttcgggccaggcacgcggctcctggtgctcggtgagcgcgggctgctggggcgcgggcgcgggcgcatgcat

SEQ ID NO: 1430 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgagacccagtacttcgggccaggcacgcggctcctggtgctcggtgagcgcgggctgctggggcgcgggcgcgggcgcatgcat

SEQ ID NO: 1431 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgagacccagtacttcgggccaggcacgcggctcctggtgctcggtgagcgcgggctgctggggcgcgggcgcgggcgcatgcat

SEQ ID NO: 1432 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgagacccagtacttcgggccaggcacgcggctcctggtgctcggtgagcgcgggctgctggggcgcgggcgcgggcgcatgcat

SEQ ID NO: 1433 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgagacccagtacttcgggccaggcacgcggctcctggtgctcggtgagcgcgggctgctggggcgcgggcgcgggcgcatgcat

SEQ ID NO: 1434 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgagacccagtacttcgggccaggcacgcggctcctggtgctcggtgagcgcgggctgctggggcgcgggcgcgggcgcatgcat

SEQ ID NO: 1435 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgagacccagtacttcgggccaggcacgcggctcctggtgctcggtgagcgcgggctgctggggcgcgggcgcgggcgcatgcat

SEQ ID NO: 1436 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgagacccagtacttcgggccaggcacgcggctcctggtgctcggtgagcgcgggctgctggggcgcgggcgcgggcgcatgcat

SEQ ID NO: 1437 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgagacccagtacttcgggccaggcacgcggctcctggtgctcggtgagcgcgggctgctggggcgcgggcgcgggcgcatgcat

SEQ ID NO: 1438 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgagacccagtacttcgggccaggcacgcggctcctggtgctcggtgagcgcgggctgctggggcgcgggcgcgggcgcatgcat

SEQ ID NO: 1439 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgagacccagtacttcgggccaggcacgcggctcctggtgctcggtgagcgcgggctgctggggcgcgggcgcgggcgcatgcat

SEQ ID NO: 1440 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgagacccagtacttcgggccaggcacgcggctcctggtgctcggtgagcgcgggctgctggggcgcgggcgcgggcgcatgcat

SEQ ID NO: 1441 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgagacccagtacttcgggccaggcacgcggctcctggtgctcggtgagcgcgggctgctggggcgcgggcgcgggcgcatgcat

SEQ ID NO: 1442 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgagacccagtacttcgggccaggcacgcggctcctggtgctcggtgagcgcgggctgctggggcgcgggcgcgggcgcatgcat

SEQ ID NO: 1443 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgagacccagtacttcgggccaggcacgcggctcctggtgctcggtgagcgcgggctgctggggcgcgggcgcgggcgcatgcat

SEQ ID NO: 1444 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgagacccagtacttcgggccaggcacgcggctcctggtgctcggtgagcgcgggctgctggggcgcgggcgcgggcgcatgcat

SEQ ID NO: 1445 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgagacccagtacttcgggccaggcacgcggctcctggtgctcggtgagcgcgggctgctggggcgcgggcgcgggcgcatgcat

SEQ ID NO: 1446 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgagacccagtacttcgggccaggcacgcggctcctggtgctcggtgagcgcgggctgctggggcgcgggcgcgggcgcatgcat

SEQ ID NO: 1447 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgagacccagtacttcgggccaggcacgcggctcctggtgctcggtgagcgcgggctgctggggcgcgggcgcgggcgcatgcat

SEQ ID NO: 1448 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgagacccagtacttcgggccaggcacgcggctcctggtgctcggtgagcgcgggctgctggggcgcgggcgcgggcgcatgcat

SEQ ID NO: 1449 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgagacccagtacttcgggccaggcacgcggctcctggtgctcggtgagcgcgggctgctggggcgcgggcgcgggcgcatgcat

SEQ ID NO: 1450 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgagacccagtacttcgggccaggcacgcggctcctggtgctcggtgagcgcgggctgctggggcgcgggcgcgggcgcatgcat

SEQ ID NO: 1451 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgagacccagtacttcgggccaggcacgcggctcctggtgctcggtgagcgcgggctgctggggcgcgggcgcgggcgcatgcat

SEQ ID NO: 1452 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgagacccagtacttcgggccaggcacgcggctcctggtgctcggtgagcgcgggctgctggggcgcgggcgcgggcgcatgcat

SEQ ID NO: 1453 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgagacccagtacttcgggccaggcacgcggctcctggtgctcggtgagcgcgggctgctggggcgcgggcgcgggcgcatgcat

SEQ ID NO: 1454 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgagacccagtacttcgggccaggcacgcggctcctggtgctcggtgagcgcgggctgctggggcgcgggcgcgggcgcatgcat

SEQ ID NO: 1455 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgggccaacgtcctgactttcggggccggcagcaggctgaccgtgctgggtgagttttcgcgggaccacccgggcgggcatgcat

SEQ ID NO: 1456 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgggccaacgtcctgactttcggggccggcagcaggctgaccgtgctgggtgagttttcgcgggaccacccgggcgggcatgcat

SEQ ID NO: 1457 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgggccaacgtcctgactttcggggccggcagcaggctgaccgtgctgggtgagttttcgcgggaccacccgggcgggcatgcat

SEQ ID NO: 1458 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgggccaacgtcctgactttcggggccggcagcaggctgaccgtgctgggtgagttttcgcgggaccacccgggcgggcatgcat

SEQ ID NO: 1459 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgggccaacgtcctgactttcggggccggcagcaggctgaccgtgctgggtgagttttcgcgggaccacccgggcgggcatgcat

SEQ ID NO: 1460 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgggccaacgtcctgactttcggggccggcagcaggctgaccgtgctgggtgagttttcgcgggaccacccgggcgggcatgcat

SEQ ID NO: 1461 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgggccaacgtcctgactttcggggccggcagcaggctgaccgtgctgggtgagttttcgcgggaccacccgggcgggcatgcat

SEQ ID NO: 1462 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgggccaacgtcctgactttcggggccggcagcaggctgaccgtgctgggtgagttttcgcgggaccacccgggcgggcatgcat

SEQ ID NO: 1463 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgggccaacgtcctgactttcggggccggcagcaggctgaccgtgctgggtgagttttcgcgggaccacccgggcgggcatgcat

SEQ ID NO: 1464 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgggccaacgtcctgactttcggggccggcagcaggctgaccgtgctgggtgagttttcgcgggaccacccgggcgggcatgcat

SEQ ID NO: 1465 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgggccaacgtcctgactttcggggccggcagcaggctgaccgtgctgggtgagttttcgcgggaccacccgggcgggcatgcat

SEQ ID NO: 1466 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgggccaacgtcctgactttcggggccggcagcaggctgaccgtgctgggtgagttttcgcgggaccacccgggcgggcatgcat

SEQ ID NO: 1467 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgggccaacgtcctgactttcggggccggcagcaggctgaccgtgctgggtgagttttcgcgggaccacccgggcgggcatgcat

SEQ ID NO: 1468 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgggccaacgtcctgactttcggggccggcagcaggctgaccgtgctgggtgagttttcgcgggaccacccgggcgggcatgcat

SEQ ID NO: 1469 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgggccaacgtcctgactttcggggccggcagcaggctgaccgtgctgggtgagttttcgcgggaccacccgggcgggcatgcat

SEQ ID NO: 1470 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgggccaacgtcctgactttcggggccggcagcaggctgaccgtgctgggtgagttttcgcgggaccacccgggcgggcatgcat

SEQ ID NO: 1471 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgggccaacgtcctgactttcggggccggcagcaggctgaccgtgctgggtgagttttcgcgggaccacccgggcgggcatgcat

SEQ ID NO: 1472 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgggccaacgtcctgactttcggggccggcagcaggctgaccgtgctgggtgagttttcgcgggaccacccgggcgggcatgcat

SEQ ID NO: 1473 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgggccaacgtcctgactttcggggccggcagcaggctgaccgtgctgggtgagttttcgcgggaccacccgggcgggcatgcat

SEQ ID NO: 1474 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgggccaacgtcctgactttcggggccggcagcaggctgaccgtgctgggtgagttttcgcgggaccacccgggcgggcatgcat

SEQ ID NO: 1475 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgggccaacgtcctgactttcggggccggcagcaggctgaccgtgctgggtgagttttcgcgggaccacccgggcgggcatgcat

SEQ ID NO: 1476 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgggccaacgtcctgactttcggggccggcagcaggctgaccgtgctgggtgagttttcgcgggaccacccgggcgggcatgcat

SEQ ID NO: 1477 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgggccaacgtcctgactttcggggccggcagcaggctgaccgtgctgggtgagttttcgcgggaccacccgggcgggcatgcat

SEQ ID NO: 1478 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgggccaacgtcctgactttcggggccggcagcaggctgaccgtgctgggtgagttttcgcgggaccacccgggcgggcatgcat

SEQ ID NO: 1479 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgggccaacgtcctgactttcggggccggcagcaggctgaccgtgctgggtgagttttcgcgggaccacccgggcgggcatgcat

SEQ ID NO: 1480 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgggccaacgtcctgactttcggggccggcagcaggctgaccgtgctgggtgagttttcgcgggaccacccgggcgggcatgcat

SEQ ID NO: 1481 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgggccaacgtcctgactttcggggccggcagcaggctgaccgtgctgggtgagttttcgcgggaccacccgggcgggcatgcat

SEQ ID NO: 1482 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgggccaacgtcctgactttcggggccggcagcaggctgaccgtgctgggtgagttttcgcgggaccacccgggcgggcatgcat

SEQ ID NO: 1483 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgggccaacgtcctgactttcggggccggcagcaggctgaccgtgctgggtgagttttcgcgggaccacccgggcgggcatgcat

SEQ ID NO: 1484 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgggccaacgtcctgactttcggggccggcagcaggctgaccgtgctgggtgagttttcgcgggaccacccgggcgggcatgcat

SEQ ID NO: 1485 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgggccaacgtcctgactttcggggccggcagcaggctgaccgtgctgggtgagttttcgcgggaccacccgggcgggcatgcat

SEQ ID NO: 1486 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgggccaacgtcctgactttcggggccggcagcaggctgaccgtgctgggtgagttttcgcgggaccacccgggcgggcatgcat

SEQ ID NO: 1487 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgggccaacgtcctgactttcggggccggcagcaggctgaccgtgctgggtgagttttcgcgggaccacccgggcgggcatgcat

SEQ ID NO: 1488 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgggccaacgtcctgactttcggggccggcagcaggctgaccgtgctgggtgagttttcgcgggaccacccgggcgggcatgcat

SEQ ID NO: 1489 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgggccaacgtcctgactttcggggccggcagcaggctgaccgtgctgggtgagttttcgcgggaccacccgggcgggcatgcat

SEQ ID NO: 1490 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgggccaacgtcctgactttcggggccggcagcaggctgaccgtgctgggtgagttttcgcgggaccacccgggcgggcatgcat

SEQ ID NO: 1491 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgggccaacgtcctgactttcggggccggcagcaggctgaccgtgctgggtgagttttcgcgggaccacccgggcgggcatgcat

SEQ ID NO: 1492 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgggccaacgtcctgactttcggggccggcagcaggctgaccgtgctgggtgagttttcgcgggaccacccgggcgggcatgcat

SEQ ID NO: 1493 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgggccaacgtcctgactttcggggccggcagcaggctgaccgtgctgggtgagttttcgcgggaccacccgggcgggcatgcat

SEQ ID NO: 1494 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgggccaacgtcctgactttcggggccggcagcaggctgaccgtgctgggtgagttttcgcgggaccacccgggcgggcatgcat

SEQ ID NO: 1495 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgggccaacgtcctgactttcggggccggcagcaggctgaccgtgctgggtgagttttcgcgggaccacccgggcgggcatgcat

SEQ ID NO: 1496 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgggccaacgtcctgactttcggggccggcagcaggctgaccgtgctgggtgagttttcgcgggaccacccgggcgggcatgcat

SEQ ID NO: 1497 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgggccaacgtcctgactttcggggccggcagcaggctgaccgtgctgggtgagttttcgcgggaccacccgggcgggcatgcat

SEQ ID NO: 1498 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgggccaacgtcctgactttcggggccggcagcaggctgaccgtgctgggtgagttttcgcgggaccacccgggcgggcatgcat

SEQ ID NO: 1499 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgggccaacgtcctgactttcggggccggcagcaggctgaccgtgctgggtgagttttcgcgggaccacccgggcgggcatgcat

SEQ ID NO: 1500 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgggccaacgtcctgactttcggggccggcagcaggctgaccgtgctgggtgagttttcgcgggaccacccgggcgggcatgcat

SEQ ID NO: 1501 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgggccaacgtcctgactttcggggccggcagcaggctgaccgtgctgggtgagttttcgcgggaccacccgggcgggcatgcat

SEQ ID NO: 1502 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgggccaacgtcctgactttcggggccggcagcaggctgaccgtgctgggtgagttttcgcgggaccacccgggcgggcatgcat

SEQ ID NO: 1503 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgggccaacgtcctgactttcggggccggcagcaggctgaccgtgctgggtgagttttcgcgggaccacccgggcgggcatgcat

SEQ ID NO: 1504 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgggccaacgtcctgactttcggggccggcagcaggctgaccgtgctgggtgagttttcgcgggaccacccgggcgggcatgcat

SEQ ID NO: 1505 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgggccaacgtcctgactttcggggccggcagcaggctgaccgtgctgggtgagttttcgcgggaccacccgggcgggcatgcat

SEQ ID NO: 1506 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgggccaacgtcctgactttcggggccggcagcaggctgaccgtgctgggtgagttttcgcgggaccacccgggcgggcatgcat

SEQ ID NO: 1507 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgggccaacgtcctgactttcggggccggcagcaggctgaccgtgctgggtgagttttcgcgggaccacccgggcgggcatgcat

SEQ ID NO: 1508 - DNA, 239 bp, Artificial Sequence
  source: /note="Description of Artificial Sequence: Synthetic polynucleotide"
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacacgagcagtacttcgggccgggcaccaggctcacggtcacaggtgagattcgggcgtctccccaccttccagccccgcatgcat

SEQ ID NO: 1509 - DNA, 239 bp, Artificial Sequence
  source: /note="Description of Artificial Sequence: Synthetic polynucleotide"
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacacgagcagtacttcgggccgggcaccaggctcacggtcacaggtgagattcgggcgtctccccaccttccagccccgcatgcat

SEQ ID NO: 1510 - DNA, 239 bp, Artificial Sequence
  source: /note="Description of Artificial Sequence: Synthetic polynucleotide"
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacacgagcagtacttcgggccgggcaccaggctcacggtcacaggtgagattcgggcgtctccccaccttccagccccgcatgcat

SEQ ID NO: 1511 - DNA, 239 bp, Artificial Sequence
  source: /note="Description of Artificial Sequence: Synthetic polynucleotide"
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacacgagcagtacttcgggccgggcaccaggctcacggtcacaggtgagattcgggcgtctccccaccttccagccccgcatgcat

SEQ ID NO: 1512 - DNA, 239 bp, Artificial Sequence
  source: /note="Description of Artificial Sequence: Synthetic polynucleotide"
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacacgagcagtacttcgggccgggcaccaggctcacggtcacaggtgagattcgggcgtctccccaccttccagccccgcatgcat

SEQ ID NO: 1513 - DNA, 239 bp, Artificial Sequence
  source: /note="Description of Artificial Sequence: Synthetic polynucleotide"
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacacgagcagtacttcgggccgggcaccaggctcacggtcacaggtgagattcgggcgtctccccaccttccagccccgcatgcat

SEQ ID NO: 1514 - DNA, 239 bp, Artificial Sequence
  source: /note="Description of Artificial Sequence: Synthetic polynucleotide"
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacacgagcagtacttcgggccgggcaccaggctcacggtcacaggtgagattcgggcgtctccccaccttccagccccgcatgcat

SEQ ID NO: 1515 - DNA, 239 bp, Artificial Sequence
  source: /note="Description of Artificial Sequence: Synthetic polynucleotide"
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacacgagcagtacttcgggccgggcaccaggctcacggtcacaggtgagattcgggcgtctccccaccttccagccccgcatgcat

SEQ ID NO: 1516 - DNA, 239 bp, Artificial Sequence
  source: /note="Description of Artificial Sequence: Synthetic polynucleotide"
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacacgagcagtacttcgggccgggcaccaggctcacggtcacaggtgagattcgggcgtctccccaccttccagccccgcatgcat

SEQ ID NO: 1517 - DNA, 239 bp, Artificial Sequence
  source: /note="Description of Artificial Sequence: Synthetic polynucleotide"
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacacgagcagtacttcgggccgggcaccaggctcacggtcacaggtgagattcgggcgtctccccaccttccagccccgcatgcat

SEQ ID NO: 1518 - DNA, 239 bp, Artificial Sequence
  source: /note="Description of Artificial Sequence: Synthetic polynucleotide"
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacacgagcagtacttcgggccgggcaccaggctcacggtcacaggtgagattcgggcgtctccccaccttccagccccgcatgcat

SEQ ID NO: 1519 - DNA, 239 bp, Artificial Sequence
  source: /note="Description of Artificial Sequence: Synthetic polynucleotide"
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacacgagcagtacttcgggccgggcaccaggctcacggtcacaggtgagattcgggcgtctccccaccttccagccccgcatgcat

SEQ ID NO: 1520 - DNA, 239 bp, Artificial Sequence
  source: /note="Description of Artificial Sequence: Synthetic polynucleotide"
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacacgagcagtacttcgggccgggcaccaggctcacggtcacaggtgagattcgggcgtctccccaccttccagccccgcatgcat

SEQ ID NO: 1521 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacacgagcagtacttcgggccgggcaccaggctcacggtcacaggtgagattcgggcgtctccccaccttccagccccgcatgcat

SEQ ID NO: 1522 - DNA, 239 bp, Artificial Sequence
  source: /note="Description of Artificial Sequence: Synthetic polynucleotide"
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacacgagcagtacttcgggccgggcaccaggctcacggtcacaggtgagattcgggcgtctccccaccttccagccccgcatgcat

SEQ ID NO: 1523 - DNA, 239 bp, Artificial Sequence
  source: /note="Description of Artificial Sequence: Synthetic polynucleotide"
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacacgagcagtacttcgggccgggcaccaggctcacggtcacaggtgagattcgggcgtctccccaccttccagccccgcatgcat

SEQ ID NO: 1524 - DNA, 239 bp, Artificial Sequence
  source: /note="Description of Artificial Sequence: Synthetic polynucleotide"
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacacgagcagtacttcgggccgggcaccaggctcacggtcacaggtgagattcgggcgtctccccaccttccagccccgcatgcat

SEQ ID NO: 1525 - DNA, 239 bp, Artificial Sequence
  source: /note="Description of Artificial Sequence: Synthetic polynucleotide"
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacacgagcagtacttcgggccgggcaccaggctcacggtcacaggtgagattcgggcgtctccccaccttccagccccgcatgcat

SEQ ID NO: 1526 - DNA, 239 bp, Artificial Sequence
  source: /note="Description of Artificial Sequence: Synthetic polynucleotide"
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacacgagcagtacttcgggccgggcaccaggctcacggtcacaggtgagattcgggcgtctccccaccttccagccccgcatgcat

SEQ ID NO: 1527 - DNA, 239 bp, Artificial Sequence
  source: /note="Description of Artificial Sequence: Synthetic polynucleotide"
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacacgagcagtacttcgggccgggcaccaggctcacggtcacaggtgagattcgggcgtctccccaccttccagccccgcatgcat

SEQ ID NO: 1528 - DNA, 239 bp, Artificial Sequence
  source: /note="Description of Artificial Sequence: Synthetic polynucleotide"
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacacgagcagtacttcgggccgggcaccaggctcacggtcacaggtgagattcgggcgtctccccaccttccagccccgcatgcat

SEQ ID NO: 1529 - DNA, 239 bp, Artificial Sequence
  source: /note="Description of Artificial Sequence: Synthetic polynucleotide"
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacacgagcagtacttcgggccgggcaccaggctcacggtcacaggtgagattcgggcgtctccccaccttccagccccgcatgcat

SEQ ID NO: 1530 - DNA, 239 bp, Artificial Sequence
  source: /note="Description of Artificial Sequence: Synthetic polynucleotide"
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacacgagcagtacttcgggccgggcaccaggctcacggtcacaggtgagattcgggcgtctccccaccttccagccccgcatgcat

SEQ ID NO: 1531 - DNA, 239 bp, Artificial Sequence
  source: /note="Description of Artificial Sequence: Synthetic polynucleotide"
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacacgagcagtacttcgggccgggcaccaggctcacggtcacaggtgagattcgggcgtctccccaccttccagccccgcatgcat

SEQ ID NO: 1532 - DNA, 239 bp, Artificial Sequence
  source: /note="Description of Artificial Sequence: Synthetic polynucleotide"
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacacgagcagtacttcgggccgggcaccaggctcacggtcacaggtgagattcgggcgtctccccaccttccagccccgcatgcat

SEQ ID NO: 1533 - DNA, 239 bp, Artificial Sequence
  source: /note="Description of Artificial Sequence: Synthetic polynucleotide"
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacacgagcagtacttcgggccgggcaccaggctcacggtcacaggtgagattcgggcgtctccccaccttccagccccgcatgcat

SEQ ID NO: 1534 - DNA, 239 bp, Artificial Sequence
  source: /note="Description of Artificial Sequence: Synthetic polynucleotide"
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacacgagcagtacttcgggccgggcaccaggctcacggtcacaggtgagattcgggcgtctccccaccttccagccccgcatgcat

SEQ ID NO: 1535 - DNA, 239 bp, Artificial Sequence
  source: /note="Description of Artificial Sequence: Synthetic polynucleotide"
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacacgagcagtacttcgggccgggcaccaggctcacggtcacaggtgagattcgggcgtctccccaccttccagccccgcatgcat

SEQ ID NO: 1536 - DNA, 239 bp, Artificial Sequence
  source: /note="Description of Artificial Sequence: Synthetic polynucleotide"
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacacgagcagtacttcgggccgggcaccaggctcacggtcacaggtgagattcgggcgtctccccaccttccagccccgcatgcat

SEQ ID NO: 1537 - DNA, 239 bp, Artificial Sequence
  source: /note="Description of Artificial Sequence: Synthetic polynucleotide"
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacacgagcagtacttcgggccgggcaccaggctcacggtcacaggtgagattcgggcgtctccccaccttccagccccgcatgcat

SEQ ID NO: 1538 - DNA, 239 bp, Artificial Sequence
  source: /note="Description of Artificial Sequence: Synthetic polynucleotide"
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacacgagcagtacttcgggccgggcaccaggctcacggtcacaggtgagattcgggcgtctccccaccttccagccccgcatgcat

SEQ ID NO: 1539 - DNA, 239 bp, Artificial Sequence
  source: /note="Description of Artificial Sequence: Synthetic polynucleotide"
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacacgagcagtacttcgggccgggcaccaggctcacggtcacaggtgagattcgggcgtctccccaccttccagccccgcatgcat

SEQ ID NO: 1540 - DNA, 239 bp, Artificial Sequence
  source: /note="Description of Artificial Sequence: Synthetic polynucleotide"
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacacgagcagtacttcgggccgggcaccaggctcacggtcacaggtgagattcgggcgtctccccaccttccagccccgcatgcat

SEQ ID NO: 1541 - DNA, 239 bp, Artificial Sequence
  source: /note="Description of Artificial Sequence: Synthetic polynucleotide"
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacacgagcagtacttcgggccgggcaccaggctcacggtcacaggtgagattcgggcgtctccccaccttccagccccgcatgcat

SEQ ID NO: 1542 - DNA, 239 bp, Artificial Sequence
  source: /note="Description of Artificial Sequence: Synthetic polynucleotide"
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacacgagcagtacttcgggccgggcaccaggctcacggtcacaggtgagattcgggcgtctccccaccttccagccccgcatgcat

SEQ ID NO: 1543 - DNA, 239 bp, Artificial Sequence
  source: /note="Description of Artificial Sequence: Synthetic polynucleotide"
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacacgagcagtacttcgggccgggcaccaggctcacggtcacaggtgagattcgggcgtctccccaccttccagccccgcatgcat

SEQ ID NO: 1544 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacacgagcagtacttcgggccgggcaccaggctcacggtcacaggtgagattcgggcgtctccccaccttccagccccgcatgcat

SEQ ID NO: 1545 - DNA, 239 bp, Artificial Sequence
  source: /note="Description of Artificial Sequence: Synthetic polynucleotide"
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacacgagcagtacttcgggccgggcaccaggctcacggtcacaggtgagattcgggcgtctccccaccttccagccccgcatgcat

SEQ ID NO: 1546 - DNA, 239 bp, Artificial Sequence
  source: /note="Description of Artificial Sequence: Synthetic polynucleotide"
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacacgagcagtacttcgggccgggcaccaggctcacggtcacaggtgagattcgggcgtctccccaccttccagccccgcatgcat

SEQ ID NO: 1547 - DNA, 239 bp, Artificial Sequence
  source: /note="Description of Artificial Sequence: Synthetic polynucleotide"
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacacgagcagtacttcgggccgggcaccaggctcacggtcacaggtgagattcgggcgtctccccaccttccagccccgcatgcat

SEQ ID NO: 1548 - DNA, 239 bp, Artificial Sequence
  source: /note="Description of Artificial Sequence: Synthetic polynucleotide"
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacacgagcagtacttcgggccgggcaccaggctcacggtcacaggtgagattcgggcgtctccccaccttccagccccgcatgcat

SEQ ID NO: 1549 - DNA, 239 bp, Artificial Sequence
  source: /note="Description of Artificial Sequence: Synthetic polynucleotide"
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacacgagcagtacttcgggccgggcaccaggctcacggtcacaggtgagattcgggcgtctccccaccttccagccccgcatgcat

SEQ ID NO: 1550 - DNA, 239 bp, Artificial Sequence
  source: /note="Description of Artificial Sequence: Synthetic polynucleotide"
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacacgagcagtacttcgggccgggcaccaggctcacggtcacaggtgagattcgggcgtctccccaccttccagccccgcatgcat

SEQ ID NO: 1551 - DNA, 239 bp, Artificial Sequence
  source: /note="Description of Artificial Sequence: Synthetic polynucleotide"
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacacgagcagtacttcgggccgggcaccaggctcacggtcacaggtgagattcgggcgtctccccaccttccagccccgcatgcat

SEQ ID NO: 1552 - DNA, 239 bp, Artificial Sequence
  source: /note="Description of Artificial Sequence: Synthetic polynucleotide"
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacacgagcagtacttcgggccgggcaccaggctcacggtcacaggtgagattcgggcgtctccccaccttccagccccgcatgcat

SEQ ID NO: 1553 - DNA, 239 bp, Artificial Sequence
  source: /note="Description of Artificial Sequence: Synthetic polynucleotide"
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacacgagcagtacttcgggccgggcaccaggctcacggtcacaggtgagattcgggcgtctccccaccttccagccccgcatgcat

SEQ ID NO: 1554 - DNA, 239 bp, Artificial Sequence
  source: /note="Description of Artificial Sequence: Synthetic polynucleotide"
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacacgagcagtacttcgggccgggcaccaggctcacggtcacaggtgagattcgggcgtctccccaccttccagccccgcatgcat

SEQ ID NO: 1555 - DNA, 239 bp, Artificial Sequence
  source: /note="Description of Artificial Sequence: Synthetic polynucleotide"
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacacgagcagtacttcgggccgggcaccaggctcacggtcacaggtgagattcgggcgtctccccaccttccagccccgcatgcat

SEQ ID NO: 1556 - DNA, 239 bp, Artificial Sequence
  source: /note="Description of Artificial Sequence: Synthetic polynucleotide"
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacacgagcagtacttcgggccgggcaccaggctcacggtcacaggtgagattcgggcgtctccccaccttccagccccgcatgcat

SEQ ID NO: 1557 - DNA, 239 bp, Artificial Sequence
  source: /note="Description of Artificial Sequence: Synthetic polynucleotide"
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacacgagcagtacttcgggccgggcaccaggctcacggtcacaggtgagattcgggcgtctccccaccttccagccccgcatgcat

SEQ ID NO: 1558 - DNA, 239 bp, Artificial Sequence
  source: /note="Description of Artificial Sequence: Synthetic polynucleotide"
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacacgagcagtacttcgggccgggcaccaggctcacggtcacaggtgagattcgggcgtctccccaccttccagccccgcatgcat

SEQ ID NO: 1559 - DNA, 239 bp, Artificial Sequence
  source: /note="Description of Artificial Sequence: Synthetic polynucleotide"
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacacgagcagtacttcgggccgggcaccaggctcacggtcacaggtgagattcgggcgtctccccaccttccagccccgcatgcat

SEQ ID NO: 1560 - DNA, 239 bp, Artificial Sequence
  source: /note="Description of Artificial Sequence: Synthetic polynucleotide"
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacacgagcagtacttcgggccgggcaccaggctcacggtcacaggtgagattcgggcgtctccccaccttccagccccgcatgcat

SEQ ID NO: 1561 - DNA, 495 bp, Artificial Sequence
  source: /note="Description of Artificial Sequence: Synthetic polynucleotide"
gccttgccagcccgctcagcaaggtcattgcctcaagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcattgcctcagtcgacattataagaaactctttggcagtggaacaacacttgttgtcacaggtaagtatcggaagaatacaacatttccaaggtaatagagggaaggcaggaaatgcaaggtcattgcctcactgatggcgcgagggaggc

SEQ ID NO: 1562 - DNA, 495 bp, Artificial Sequence
  source: /note="Description of Artificial Sequence: Synthetic polynucleotide"
gccttgccagcccgctcaggcataactttgcctcacagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataactttgcctcagtcgacattataagaaactctttggcagtggaacaacacttgttgtcacaggtaagtatcggaagaatacaacatttccaaggtaatagagggaaggcaggaaatggcataactttgcctcactgatggcgcgagggaggc

SEQ ID NO: 1563 - DNA, 495 bp, Artificial Sequence
  source: /note="Description of Artificial Sequence: Synthetic polynucleotide"
gccttgccagcccgctcagctctgattttgcctcacagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgattttgcctcagtcgacattataagaaactctttggcagtggaacaacacttgttgtcacaggtaagtatcggaagaatacaacatttccaaggtaatagagggaaggcaggaaatgctctgattttgcctcactgatggcgcgagggaggc

SEQ ID NO: 1564 - DNA, 495 bp, Artificial Sequence
  source: /note="Description of Artificial Sequence: Synthetic polynucleotide"
gccttgccagcccgctcagtacgtacgttgcctcacagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgttgcctcagtcgacattataagaaactctttggcagtggaacaacacttgttgtcacaggtaagtatcggaagaatacaacatttccaaggtaatagagggaaggcaggaaatgtacgtacgttgcctcactgatggcgcgagggaggc

SEQ ID NO: 1565 - DNA, 495 bp, Artificial Sequence
  source: /note="Description of Artificial Sequence: Synthetic polynucleotide"
gccttgccagcccgctcagtacgcgttttgcctcacagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgttttgcctcagtcgacattataagaaactctttggcagtggaacaacacttgttgtcacaggtaagtatcggaagaatacaacatttccaaggtaatagagggaaggcaggaaatgtacgcgttttgcctcactgatggcgcgagggaggc

SEQ ID NO: 1566 - DNA, 495 bp, Artificial Sequence
  source: /note="Description of Artificial Sequence: Synthetic polynucleotide"
gccttgccagcccgctcagctcagtgattgcctcacagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgattgcctcagtcgacattataagaaactctttggcagtggaacaacacttgttgtcacaggtaagtatcggaagaatacaacatttccaaggtaatagagggaaggcaggaaatgctcagtgattgcctcactgatggcgcgagggaggc

SEQ ID NO: 1567 - DNA, 495 bp, Artificial Sequence
  source: /note="Description of Artificial Sequence: Synthetic polynucleotide"
gccttgccagcccgctcagtctgatatttgcctcaagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatatttgcctcagtcgacattataagaaactctttggcagtggaacaacacttgttgtcacaggtaagtatcggaagaatacaacatttccaaggtaatagagggaaggcaggaaatgtctgatatttgcctcactgatggcgcgagggaggc

SEQ ID NO: 1568 - DNA, 495 bp, Artificial Sequence
  source: /note="Description of Artificial Sequence: Synthetic polynucleotide"
gccttgccagcccgctcagcatatgctttgcctcaagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgctttgcctcagtcgacattataagaaactctttggcagtggaacaacacttgttgtcacaggtaagtatcggaagaatacaacatttccaaggtaatagagggaaggcaggaaatgcatatgctttgcctcactgatggcgcgagggaggc

SEQ ID NO: 1569 - DNA, 495 bp, Artificial Sequence
  source: /note="Description of Artificial Sequence: Synthetic polynucleotide"
gccttgccagcccgctcagcgtaattattgcctcacagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattattgcctcagtcgacattataagaaactctttggcagtggaacaacacttgttgtcacaggtaagtatcggaagaatacaacatttccaaggtaatagagggaaggcaggaaatgcgtaattattgcctcactgatggcgcgagggaggc

SEQ ID NO: 1570 - DNA, 495 bp, Artificial Sequence
  source: /note="Description of Artificial Sequence: Synthetic polynucleotide"
gccttgccagcccgctcagacgtactcttgcctcagcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactcttgcctcagtcgacattataagaaactctttggcagtggaacaacacttgttgtcacaggtaagtatcggaagaatacaacatttccaaggtaatagagggaaggcaggaaatgacgtactcttgcctcactgatggcgcgagggaggc

SEQ ID NO: 1571 - DNA, 495 bp, Artificial Sequence
  source: /note="Description of Artificial Sequence: Synthetic polynucleotide"
gccttgccagcccgctcagcttctaagttgcctcattatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagttgcctcagtcgacattataagaaactctttggcagtggaacaacacttgttgtcacaggtaagtatcggaagaatacaacatttccaaggtaatagagggaaggcaggaaatgcttctaagttgcctcactgatggcgcgagggaggc

SEQ ID NO: 1572 - DNA, 495 bp, Artificial Sequence
  source: /note="Description of Artificial Sequence: Synthetic polynucleotide"
gccttgccagcccgctcagactatgacttgcctcagggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgacttgcctcagtcgacattataagaaactctttggcagtggaacaacacttgttgtcacaggtaagtatcggaagaatacaacatttccaaggtaatagagggaaggcaggaaatgactatgacttgcctcactgatggcgcgagggaggc

SEQ ID NO: 1573 - DNA, 495 bp, Artificial Sequence
  source: /note="Description of Artificial Sequence: Synthetic polynucleotide"
gccttgccagcccgctcaggacgttaattgcctcatccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaattgcctcagtcgacattataagaaactctttggcagtggaacaacacttgttgtcacaggtaagtatcggaagaatacaacatttccaaggtaatagagggaaggcaggaaatggacgttaattgcctcactgatggcgcgagggaggc

SEQ ID NO: 1574 - DNA, 495 bp, Artificial Sequence
  source: /note="Description of Artificial Sequence: Synthetic polynucleotide"
gccttgccagcccgctcagacaagatattgcctcagcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatattgcctcagtcgacattataagaaactctttggcagtggaacaacacttgttgtcacaggtaagtatcggaagaatacaacatttccaaggtaatagagggaaggcaggaaatgacaagatattgcctcactgatggcgcgagggaggc

SEQ ID NO: 1575 - DNA, 495 bp, Artificial Sequence
  source: /note="Description of Artificial Sequence: Synthetic polynucleotide"
gccttgccagcccgctcagcaaggtcatcgttagcagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatcgttagcgtcgacattataagaaactctttggcagtggaacaacacttgttgtcacaggtaagtatcggaagaatacaacatttccaaggtaatagagggaaagcaggaaattcaaggtcatcgttagcctgatggcgcgagggaggc

SEQ ID NO: 1576 - DNA, 495 bp, Artificial Sequence
  source: /note="Description of Artificial Sequence: Synthetic polynucleotide"
gccttgccagcccgctcaggcataacttcgttagccagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttcgttagcgtcgacattataagaaactctttggcagtggaacaacacttgttgtcacaggtaagtatcggaagaatacaacatttccaaggtaatagagggaaagcaggaaattgcataacttcgttagcctgatggcgcgagggaggc

SEQ ID NO: 1577 - DNA, 495 bp, Artificial Sequence
  source: /note="Description of Artificial Sequence: Synthetic polynucleotide"
gccttgccagcccgctcagctctgatttcgttagccagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttcgttagcgtcgacattataagaaactctttggcagtggaacaacacttgttgtcacaggtaagtatcggaagaatacaacatttccaaggtaatagagggaaagcaggaaattctctgatttcgttagcctgatggcgcgagggaggc

SEQ ID NO: 1578 - DNA, 495 bp, Artificial Sequence
  source: /note="Description of Artificial Sequence: Synthetic polynucleotide"
gccttgccagcccgctcagtacgtacgtcgttagccagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtcgttagcgtcgacattataagaaactctttggcagtggaacaacacttgttgtcacaggtaagtatcggaagaatacaacatttccaaggtaatagagggaaagcaggaaatttacgtacgtcgttagcctgatggcgcgagggaggc

SEQ ID NO: 1579 - DNA, 495 bp, Artificial Sequence
  source: /note="Description of Artificial Sequence: Synthetic polynucleotide"
gccttgccagcccgctcagtacgcgtttcgttagccagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttcgttagcgtcgacattataagaaactctttggcagtggaacaacacttgttgtcacaggtaagtatcggaagaatacaacatttccaaggtaatagagggaaagcaggaaatttacgcgtttcgttagcctgatggcgcgagggaggc

SEQ ID NO: 1580 - DNA, 495 bp, Artificial Sequence
  source: /note="Description of Artificial Sequence: Synthetic polynucleotide"
gccttgccagcccgctcagctcagtgatcgttagccagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatcgttagcgtcgacattataagaaactctttggcagtggaacaacacttgttgtcacaggtaagtatcggaagaatacaacatttccaaggtaatagagggaaagcaggaaattctcagtgatcgttagcctgatggcgcgagggaggc

SEQ ID NO: 1581 - DNA, 495 bp, Artificial Sequence
  source: /note="Description of Artificial Sequence: Synthetic polynucleotide"
gccttgccagcccgctcagtctgatattcgttagcagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattcgttagcgtcgacattataagaaactctttggcagtggaacaacacttgttgtcacaggtaagtatcggaagaatacaacatttccaaggtaatagagggaaagcaggaaatttctgatattcgttagcctgatggcgcgagggaggc

SEQ ID NO: 1582 - DNA, 495 bp, Artificial Sequence
  source: /note="Description of Artificial Sequence: Synthetic polynucleotide"
gccttgccagcccgctcagcatatgcttcgttagcagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttcgttagcgtcgacattataagaaactctttggcagtggaacaacacttgttgtcacaggtaagtatcggaagaatacaacatttccaaggtaatagagggaaagcaggaaattcatatgcttcgttagcctgatggcgcgagggaggc

SEQ ID NO: 1583 - DNA, 495 bp, Artificial Sequence
  source: /note="Description of Artificial Sequence: Synthetic polynucleotide"
gccttgccagcccgctcagcgtaattatcgttagccagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatcgttagcgtcgacattataagaaactctttggcagtggaacaacacttgttgtcacaggtaagtatcggaagaatacaacatttccaaggtaatagagggaaagcaggaaattcgtaattatcgttagcctgatggcgcgagggaggc

SEQ ID NO: 1584 - DNA, 495 bp, Artificial Sequence
  source: /note="Description of Artificial Sequence: Synthetic polynucleotide"
gccttgccagcccgctcagacgtactctcgttagcgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctcgttagcgtcgacattataagaaactctttggcagtggaacaacacttgttgtcacaggtaagtatcggaagaatacaacatttccaaggtaatagagggaaagcaggaaattacgtactctcgttagcctgatggcgcgagggaggc

SEQ ID NO: 1585 - DNA, 495 bp, Artificial Sequence
  source: /note="Description of Artificial Sequence: Synthetic polynucleotide"
gccttgccagcccgctcagcttctaagtcgttagcttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtcgttagcgtcgacattataagaaactctttggcagtggaacaacacttgttgtcacaggtaagtatcggaagaatacaacatttccaaggtaatagagggaaagcaggaaattcttctaagtcgttagcctgatggcgcgagggaggc

SEQ ID NO: 1586 - DNA, 495 bp, Artificial Sequence
  source: /note="Description of Artificial Sequence: Synthetic polynucleotide"
gccttgccagcccgctcagactatgactcgttagcgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactcgttagcgtcgacattataagaaactctttggcagtggaacaacacttgttgtcacaggtaagtatcggaagaatacaacatttccaaggtaatagagggaaagcaggaaattactatgactcgttagcctgatggcgcgagggaggc

SEQ ID NO: 1587 - DNA, 495 bp, Artificial Sequence
  source: /note="Description of Artificial Sequence: Synthetic polynucleotide"
gccttgccagcccgctcaggacgttaatcgttagctccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatcgttagcgtcgacattataagaaactctttggcagtggaacaacacttgttgtcacaggtaagtatcggaagaatacaacatttccaaggtaatagagggaaagcaggaaattgacgttaatcgttagcctgatggcgcgagggaggc

SEQ ID NO: 1588 - DNA, 495 bp, Artificial Sequence
  source: /note="Description of Artificial Sequence: Synthetic polynucleotide"
gccttgccagcccgctcagacaagatatcgttagcgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatcgttagcgtcgacattataagaaactctttggcagtggaacaacacttgttgtcacaggtaagtatcggaagaatacaacatttccaaggtaatagagggaaagcaggaaattacaagatatcgttagcctgatggcgcgagggaggc

SEQ ID NO: 1589 - DNA, 495 bp, Artificial Sequence
  source: /note="Description of Artificial Sequence: Synthetic polynucleotide"
gccttgccagcccgctcagcaaggtcatatagttcagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatatagttcgtcgacaagagttgggcaaaaaaatcaaggtatttggtcccggaacaaagcttatcattacaggtaagttttctttaaattttgcaatgtaaagaagggatgggagcaaggtcatatagttcctgatggcgcgagggaggc

SEQ ID NO: 1590 - DNA, 495 bp, Artificial Sequence
  source: /note="Description of Artificial Sequence: Synthetic polynucleotide"
gccttgccagcccgctcaggcataacttatagttccagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttatagttcgtcgacaagagttgggcaaaaaaatcaaggtatttggtcccggaacaaagcttatcattacaggtaagttttctttaaattttgcaatgtaaagaagggatgggaggcataacttatagttcctgatggcgcgagggaggc

SEQ ID NO: 1591 - DNA, 495 bp, Artificial Sequence
  source: /note="Description of Artificial Sequence: Synthetic polynucleotide"
gccttgccagcccgctcagctctgatttatagttccagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttatagttcgtcgacaagagttgggcaaaaaaatcaaggtatttggtcccggaacaaagcttatcattacaggtaagttttctttaaattttgcaatgtaaagaagggatgggagctctgatttatagttcctgatggcgcgagggaggc

SEQ ID NO: 1592 - DNA, 495 bp, Artificial Sequence
  source: /note="Description of Artificial Sequence: Synthetic polynucleotide"
gccttgccagcccgctcagtacgtacgtatagttccagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtatagttcgtcgacaagagttgggcaaaaaaatcaaggtatttggtcccggaacaaagcttatcattacaggtaagttttctttaaattttgcaatgtaaagaagggatgggagtacgtacgtatagttcctgatggcgcgagggaggc

SEQ ID NO: 1593 - DNA, 495 bp, Artificial Sequence
  source: /note="Description of Artificial Sequence: Synthetic polynucleotide"
gccttgccagcccgctcagtacgcgtttatagttccagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttatagttcgtcgacaagagttgggcaaaaaaatcaaggtatttggtcccggaacaaagcttatcattacaggtaagttttctttaaattttgcaatgtaaagaagggatgggagtacgcgtttatagttcctgatggcgcgagggaggc

SEQ ID NO: 1594 - DNA, 495 bp, Artificial Sequence
  source: /note="Description of Artificial Sequence: Synthetic polynucleotide"
gccttgccagcccgctcagctcagtgatatagttccagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatatagttcgtcgacaagagttgggcaaaaaaatcaaggtatttggtcccggaacaaagcttatcattacaggtaagttttctttaaattttgcaatgtaaagaagggatgggagctcagtgatatagttcctgatggcgcgagggaggc

SEQ ID NO: 1595 - DNA, 495 bp, Artificial Sequence
  source: /note="Description of Artificial Sequence: Synthetic polynucleotide"
gccttgccagcccgctcagtctgatattatagttcagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattatagttcgtcgacaagagttgggcaaaaaaatcaaggtatttggtcccggaacaaagcttatcattacaggtaagttttctttaaattttgcaatgtaaagaagggatgggagtctgatattatagttcctgatggcgcgagggaggc

SEQ ID NO: 1596 - DNA, 495 bp, Artificial Sequence
  source: /note="Description of Artificial Sequence: Synthetic polynucleotide"
gccttgccagcccgctcagcatatgcttatagttcagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttatagttcgtcgacaagagttgggcaaaaaaatcaaggtatttggtcccggaacaaagcttatcattacaggtaagttttctttaaattttgcaatgtaaagaagggatgggagcatatgcttatagttcctgatggcgcgagggaggc

SEQ ID NO: 1597 - DNA, 495 bp, Artificial Sequence
  source: /note="Description of Artificial Sequence: Synthetic polynucleotide"
gccttgccagcccgctcagcgtaattatatagttccagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatatagttcgtcgacaagagttgggcaaaaaaatcaaggtatttggtcccggaacaaagcttatcattacaggtaagttttctttaaattttgcaatgtaaagaagggatgggagcgtaattatatagttcctgatggcgcgagggaggc

SEQ ID NO: 1598 - DNA, 495 bp, Artificial Sequence
  source: /note="Description of Artificial Sequence: Synthetic polynucleotide"
gccttgccagcccgctcagacgtactctatagttcgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctatagttcgtcgacaagagttgggcaaaaaaatcaaggtatttggtcccggaacaaagcttatcattacaggtaagttttctttaaattttgcaatgtaaagaagggatgggagacgtactctatagttcctgatggcgcgagggaggc

SEQ ID NO: 1599 - DNA, 495 bp, Artificial Sequence
  source: /note="Description of Artificial Sequence: Synthetic polynucleotide"
gccttgccagcccgctcagcttctaagtatagttcttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtatagttcgtcgacaagagttgggcaaaaaaatcaaggtatttggtcccggaacaaagcttatcattacaggtaagttttctttaaattttgcaatgtaaagaagggatgggagcttctaagtatagttcctgatggcgcgagggaggc

SEQ ID NO: 1600 - DNA, 495 bp, Artificial Sequence
  source: /note="Description of Artificial Sequence: Synthetic polynucleotide"
gccttgccagcccgctcagactatgactatagttcgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactatagttcgtcgacaagagttgggcaaaaaaatcaaggtatttggtcccggaacaaagcttatcattacaggtaagttttctttaaattttgcaatgtaaagaagggatgggagactatgactatagttcctgatggcgcgagggaggc

SEQ ID NO: 1601 - DNA, 495 bp, Artificial Sequence
  source: /note="Description of Artificial Sequence: Synthetic polynucleotide"
gccttgccagcccgctcaggacgttaatatagttctccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatatagttcgtcgacaagagttgggcaaaaaaatcaaggtatttggtcccggaacaaagcttatcattacaggtaagttttctttaaattttgcaatgtaaagaagggatgggaggacgttaatatagttcctgatggcgcgagggaggc

SEQ ID NO: 1602 - DNA, 495 bp, Artificial Sequence
  source: /note="Description of Artificial Sequence: Synthetic polynucleotide"
gccttgccagcccgctcagacaagatatatagttcgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatatagttcgtcgacaagagttgggcaaaaaaatcaaggtatttggtcccggaacaaagcttatcattacaggtaagttttctttaaattttgcaatgtaaagaagggatgggagacaagatatatagttcctgatggcgcgagggaggc

SEQ ID NO: 1603 - DNA, 495 bp, Artificial Sequence
  source: /note="Description of Artificial Sequence: Synthetic polynucleotide"
gccttgccagcccgctcagcaaggtcatggcgtatagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatggcgtatgtcgacactggttggttcaagatatttgctgaagggactaagctcatagtaacttcacctggtaagtaacttttctttctgtttttattccagtaatgaaaaactgcaaggtcatggcgtatctgatggcgcgagggaggc

SEQ ID NO: 1604 - DNA, 495 bp, Artificial Sequence
  source: /note="Description of Artificial Sequence: Synthetic polynucleotide"
gccttgccagcccgctcaggcataacttggcgtatcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttggcgtatgtcgacactggttggttcaagatatttgctgaagggactaagctcatagtaacttcacctggtaagtaacttttctttctgtttttattccagtaatgaaaaactggcataacttggcgtatctgatggcgcgagggaggc

SEQ ID NO: 1605 - DNA, 495 bp, Artificial Sequence
  source: /note="Description of Artificial Sequence: Synthetic polynucleotide"
gccttgccagcccgctcagctctgatttggcgtatcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttggcgtatgtcgacactggttggttcaagatatttgctgaagggactaagctcatagtaacttcacctggtaagtaacttttctttctgtttttattccagtaatgaaaaactgctctgatttggcgtatctgatggcgcgagggaggc

SEQ ID NO: 1606 - DNA, 495 bp, Artificial Sequence
  source: /note="Description of Artificial Sequence: Synthetic polynucleotide"
gccttgccagcccgctcagtacgtacgtggcgtatcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtggcgtatgtcgacactggttggttcaagatatttgctgaagggactaagctcatagtaacttcacctggtaagtaacttttctttctgtttttattccagtaatgaaaaactgtacgtacgtggcgtatctgatggcgcgagggaggc

SEQ ID NO: 1607 - DNA, 495 bp, Artificial Sequence
  source: /note="Description of Artificial Sequence: Synthetic polynucleotide"
gccttgccagcccgctcagtacgcgtttggcgtatcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttggcgtatgtcgacactggttggttcaagatatttgctgaagggactaagctcatagtaacttcacctggtaagtaacttttctttctgtttttattccagtaatgaaaaactgtacgcgtttggcgtatctgatggcgcgagggaggc

SEQ ID NO: 1608 - DNA, 495 bp, Artificial Sequence
  source: /note="Description of Artificial Sequence: Synthetic polynucleotide"
gccttgccagcccgctcagctcagtgatggcgtatcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatggcgtatgtcgacactggttggttcaagatatttgctgaagggactaagctcatagtaacttcacctggtaagtaacttttctttctgtttttattccagtaatgaaaaactgctcagtgatggcgtatctgatggcgcgagggaggc

SEQ ID NO: 1609 - DNA, 495 bp, Artificial Sequence
  source: /note="Description of Artificial Sequence: Synthetic polynucleotide"
gccttgccagcccgctcagtctgatattggcgtatagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattggcgtatgtcgacactggttggttcaagatatttgctgaagggactaagctcatagtaacttcacctggtaagtaacttttctttctgtttttattccagtaatgaaaaactgtctgatattggcgtatctgatggcgcgagggaggc

SEQ ID NO: 1610 - DNA, 495 bp, Artificial Sequence
  source: /note="Description of Artificial Sequence: Synthetic polynucleotide"
gccttgccagcccgctcagcatatgcttggcgtatagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttggcgtatgtcgacactggttggttcaagatatttgctgaagggactaagctcatagtaacttcacctggtaagtaacttttctttctgtttttattccagtaatgaaaaactgcatatgcttggcgtatctgatggcgcgagggaggc

SEQ ID NO: 1611 - DNA, 495 bp, Artificial Sequence
  source: /note="Description of Artificial Sequence: Synthetic polynucleotide"
gccttgccagcccgctcagcgtaattatggcgtatcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatggcgtatgtcgacactggttggttcaagatatttgctgaagggactaagctcatagtaacttcacctggtaagtaacttttctttctgtttttattccagtaatgaaaaactgcgtaattatggcgtatctgatggcgcgagggaggc

SEQ ID NO: 1612 - DNA, 495 bp, Artificial Sequence
  source: /note="Description of Artificial Sequence: Synthetic polynucleotide"
gccttgccagcccgctcagacgtactctggcgtatgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctggcgtatgtcgacactggttggttcaagatatttgctgaagggactaagctcatagtaacttcacctggtaagtaacttttctttctgtttttattccagtaatgaaaaactgacgtactctggcgtatctgatggcgcgagggaggc

SEQ ID NO: 1613 - DNA, 495 bp, Artificial Sequence
  source: /note="Description of Artificial Sequence: Synthetic polynucleotide"
gccttgccagcccgctcagcttctaagtggcgtatttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtggcgtatgtcgacactggttggttcaagatatttgctgaagggactaagctcatagtaacttcacctggtaagtaacttttctttctgtttttattccagtaatgaaaaactgcttctaagtggcgtatctgatggcgcgagggaggc

SEQ ID NO: 1614 - DNA, 495 bp, Artificial Sequence
  source: /note="Description of Artificial Sequence: Synthetic polynucleotide"
gccttgccagcccgctcagactatgactggcgtatgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactggcgtatgtcgacactggttggttcaagatatttgctgaagggactaagctcatagtaacttcacctggtaagtaacttttctttctgtttttattccagtaatgaaaaactgactatgactggcgtatctgatggcgcgagggaggc

SEQ ID NO: 1615 - DNA, 495 bp, Artificial Sequence
  source: /note="Description of Artificial Sequence: Synthetic polynucleotide"
gccttgccagcccgctcaggacgttaatggcgtattccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatggcgtatgtcgacactggttggttcaagatatttgctgaagggactaagctcatagtaacttcacctggtaagtaacttttctttctgtttttattccagtaatgaaaaactggacgttaatggcgtatctgatggcgcgagggaggc

SEQ ID NO: 1616 - DNA, 495 bp, Artificial Sequence
  source: /note="Description of Artificial Sequence: Synthetic polynucleotide"
gccttgccagcccgctcagacaagatatggcgtatgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatggcgtatgtcgacactggttggttcaagatatttgctgaagggactaagctcatagtaacttcacctggtaagtaacttttctttctgtttttattccagtaatgaaaaactgacaagatatggcgtatctgatggcgcgagggaggc

SEQ ID NO: 1617 - DNA, 495 bp, Artificial Sequence
  source: /note="Description of Artificial Sequence: Synthetic polynucleotide"
gccttgccagcccgctcagcaaggtcatggacatgagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatggacatggtcgacagtgattggatcaagacgtttgcaaaagggactaggctcatagtaacttcgcctggtaagtaattttttttctgtttttattccagtaatgaaaaactgacaaggtcatggacatgctgatggcgcgagggaggc

SEQ ID NO: 1618 - DNA, 495 bp, Artificial Sequence
  source: /note="Description of Artificial Sequence: Synthetic polynucleotide"
gccttgccagcccgctcaggcataacttggacatgcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttggacatggtcgacagtgattggatcaagacgtttgcaaaagggactaggctcatagtaacttcgcctggtaagtaattttttttctgtttttattccagtaatgaaaaactgagcataacttggacatgctgatggcgcgagggaggc

SEQ ID NO: 1619 - DNA, 495 bp, Artificial Sequence
  source: /note="Description of Artificial Sequence: Synthetic polynucleotide"
gccttgccagcccgctcagctctgatttggacatgcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttggacatggtcgacagtgattggatcaagacgtttgcaaaagggactaggctcatagtaacttcgcctggtaagtaattttttttctgtttttattccagtaatgaaaaactgactctgatttggacatgctgatggcgcgagggaggc

SEQ ID NO: 1620 - DNA, 495 bp, Artificial Sequence
  source: /note="Description of Artificial Sequence: Synthetic polynucleotide"
gccttgccagcccgctcagtacgtacgtggacatgcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtggacatggtcgacagtgattggatcaagacgtttgcaaaagggactaggctcatagtaacttcgcctggtaagtaattttttttctgtttttattccagtaatgaaaaactgatacgtacgtggacatgctgatggcgcgagggaggc

SEQ ID NO: 1621 - DNA, 495 bp, Artificial Sequence
  source: /note="Description of Artificial Sequence: Synthetic polynucleotide"
gccttgccagcccgctcagtacgcgtttggacatgcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttggacatggtcgacagtgattggatcaagacgtttgcaaaagggactaggctcatagtaacttcgcctggtaagtaattttttttctgtttttattccagtaatgaaaaactgatacgcgtttggacatgctgatggcgcgagggaggc

SEQ ID NO: 1622 - DNA, 495 bp, Artificial Sequence
  source: /note="Description of Artificial Sequence: Synthetic polynucleotide"
gccttgccagcccgctcagctcagtgatggacatgcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatggacatggtcgacagtgattggatcaagacgtttgcaaaagggactaggctcatagtaacttcgcctggtaagtaattttttttctgtttttattccagtaatgaaaaactgactcagtgatggacatgctgatggcgcgagggaggc

SEQ ID NO: 1623 - DNA, 495 bp, Artificial Sequence
  source: /note="Description of Artificial Sequence: Synthetic polynucleotide"
gccttgccagcccgctcagtctgatattggacatgagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattggacatggtcgacagtgattggatcaagacgtttgcaaaagggactaggctcatagtaacttcgcctggtaagtaattttttttctgtttttattccagtaatgaaaaactgatctgatattggacatgctgatggcgcgagggaggc

SEQ ID NO: 1624 - DNA, 495 bp, Artificial Sequence
  source: /note="Description of Artificial Sequence: Synthetic polynucleotide"
gccttgccagcccgctcagcatatgcttggacatgagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttggacatggtcgacagtgattggatcaagacgtttgcaaaagggactaggctcatagtaacttcgcctggtaagtaattttttttctgtttttattccagtaatgaaaaactgacatatgcttggacatgctgatggcgcgagggaggc

SEQ ID NO: 1625 - DNA, 495 bp, Artificial Sequence
  source: /note="Description of Artificial Sequence: Synthetic polynucleotide"
gccttgccagcccgctcagcgtaattatggacatgcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatggacatggtcgacagtgattggatcaagacgtttgcaaaagggactaggctcatagtaacttcgcctggtaagtaattttttttctgtttttattccagtaatgaaaaactgacgtaattatggacatgctgatggcgcgagggaggc

SEQ ID NO: 1626 - DNA, 495 bp, Artificial Sequence
  source: /note="Description of Artificial Sequence: Synthetic polynucleotide"
gccttgccagcccgctcagacgtactctggacatggcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctggacatggtcgacagtgattggatcaagacgtttgcaaaagggactaggctcatagtaacttcgcctggtaagtaattttttttctgtttttattccagtaatgaaaaactgaacgtactctggacatgctgatggcgcgagggaggc

SEQ ID NO: 1627 - DNA, 495 bp, Artificial Sequence
  source: /note="Description of Artificial Sequence: Synthetic polynucleotide"
gccttgccagcccgctcagcttctaagtggacatgttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtggacatggtcgacagtgattggatcaagacgtttgcaaaagggactaggctcatagtaacttcgcctggtaagtaattttttttctgtttttattccagtaatgaaaaactgacttctaagtggacatgctgatggcgcgagggaggc

SEQ ID NO: 1628 - DNA, 495 bp, Artificial Sequence
  source: /note="Description of Artificial Sequence: Synthetic polynucleotide"
gccttgccagcccgctcagactatgactggacatggggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactggacatggtcgacagtgattggatcaagacgtttgcaaaagggactaggctcatagtaacttcgcctggtaagtaattttttttctgtttttattccagtaatgaaaaactgaactatgactggacatgctgatggcgcgagggaggc

SEQ ID NO: 1629 - DNA, 495 bp, Artificial Sequence
  source: /note="Description of Artificial Sequence: Synthetic polynucleotide"
gccttgccagcccgctcaggacgttaatggacatgtccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatggacatggtcgacagtgattggatcaagacgtttgcaaaagggactaggctcatagtaacttcgcctggtaagtaattttttttctgtttttattccagtaatgaaaaactgagacgttaatggacatgctgatggcgcgagggaggc

SEQ ID NO: 1630 - DNA, 495 bp, Artificial Sequence
  source: /note="Description of Artificial Sequence: Synthetic polynucleotide"
gccttgccagcccgctcagacaagatatggacatggcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatggacatggtcgacagtgattggatcaagacgtttgcaaaagggactaggctcatagtaacttcgcctggtaagtaattttttttctgtttttattccagtaatgaaaaactgaacaagatatggacatgctgatggcgcgagggaggc

SEQ ID NO: 1631 - DNA, 35 bp, Artificial Sequence
  source: /note="Description of Artificial Sequence: Synthetic primer"
ttacctacaactgtgagtctggtgccttgtccaaa

SEQ ID NO: 1632 - DNA, 33 bp, Artificial Sequence
  source: /note="Description of Artificial Sequence: Synthetic primer"
acctacaacggttaacctggtccccgaaccgaa

SEQ ID NO: 1633 - DNA, 33 bp, Artificial Sequence
  source: /note="Description of Artificial Sequence: Synthetic primer"
acctacaacagtgagccaacttccctctccaaa

SEQ ID NO: 1634 - DNA, 31 bp, Artificial Sequence
  source: /note="Description of Artificial Sequence: Synthetic primer"
ccaagacagagagctgggttccactgccaaa

SEQ ID NO: 1635 - DNA, 33 bp, Artificial Sequence
  source: /note="Description of Artificial Sequence: Synthetic primer"
acctaggatggagagtcgagtcccatcaccaaa

SEQ ID NO: 1636 - DNA, 31 bp, Artificial Sequence
  source: /note="Description of Artificial Sequence: Synthetic primer"
ctgtcacagtgagcctggtcccgttcccaaa

SEQ ID NO: 1637 - DNA, 25 bp, Artificial Sequence
  source: /note="Description of Artificial Sequence: Synthetic primer"
cggtgagccgtgtccctggcccgaa

SEQ ID NO: 1638 - DNA, 31 bp, Artificial Sequence
  source: /note="Description of Artificial Sequence: Synthetic primer"
ccagtacggtcagcctagagccttctccaaa

SEQ ID NO: 1639 - DNA, 26 bp, Artificial Sequence
  source: /note="Description of Artificial Sequence: Synthetic primer"
actgtcagccgggtgcctgggccaaa

SEQ ID NO: 1640 - DNA, 22 bp, Artificial Sequence
  source: /note="Description of Artificial Sequence: Synthetic primer"
agagccgggtcccggcgccgaa

SEQ ID NO: 1641 - DNA, 22 bp, Artificial Sequence
  source: /note="Description of Artificial Sequence: Synthetic primer"
ggagccgcgtgcctggcccgaa

SEQ ID NO: 1642 - DNA, 23 bp, Artificial Sequence
  source: /note="Description of Artificial Sequence: Synthetic primer"
gtcagcctgctgccggccccgaa

SEQ ID NO: 1643 - DNA, 23 bp, Artificial Sequence
  source: /note="Description of Artificial Sequence: Synthetic primer"
gtgagcctggtgcccggcccgaa

SEQ ID NO: 1644 - DNA, 29 bp, Artificial Sequence
  source: /note="Description of Artificial Sequence: Synthetic primer"
aacaaaggagaagtctcagatggctacag

SEQ ID NO: 1645 - DNA, 29 bp, Artificial Sequence
  source: /note="Description of Artificial Sequence: Synthetic primer"
gataaaggagaagtccccgatggctatgt

SEQ ID NO: 1646 - DNA, 29 bp, Artificial Sequence
  source: /note="Description of Artificial Sequence: Synthetic primer"
gacaaaggagaagtctcagatggctatag

SEQ ID NO: 1647 - DNA, 29 bp, Artificial Sequence
  source: /note="Description of Artificial Sequence: Synthetic primer"
gccaaaggagaggtccctgatggctacaa

SEQ ID NO: 1648 - DNA, 29 bp, Artificial Sequence
  source: /note="Description of Artificial Sequence: Synthetic primer"
ctctagattaaacacagaggatttcccac

SEQ ID NO: 1649 - DNA, 29 bp, Artificial Sequence
  source: /note="Description of Artificial Sequence: Synthetic primer"
aaggagaagtccccgatggctacaatgta

SEQ ID NO: 1650 - DNA, 29 bp, Artificial Sequence
  source: /note="Description of Artificial Sequence: Synthetic primer"
aaggagaagtccccaatggctacaatgtc

SEQ ID NO: 1651 - DNA, 30 bp, Artificial Sequence
  source: /note="Description of Artificial Sequence: Synthetic primer"
gacaaaggagaagtcccgaatggctacaac

SEQ ID NO: 1652 - DNA, 29 bp, Artificial Sequence
  source: /note="Description of Artificial Sequence: Synthetic primer"
gttcccaatggctacaatgtctccagatc

SEQ ID NO: 1653 - DNA, 29 bp, Artificial Sequence
  source: /note="Description of Artificial Sequence: Synthetic primer"
gtccccaatggctacaatgtctccagatt

SEQ ID NO: 1654 - DNA, 29 bp, Artificial Sequence
  source: /note="Description of Artificial Sequence: Synthetic primer"
gtccctgatggttatagtgtctccagagc

SEQ ID NO: 1655 - DNA, 29 bp, Artificial Sequence
  source: /note="Description of Artificial Sequence: Synthetic primer"
atctctgatggatacagtgtctctcgaca

SEQ ID NO: 1656 - DNA, 29 bp, Artificial Sequence
  source: /note="Description of Artificial Sequence: Synthetic primer"
tttcctctgagtcaacagtctccagaata

SEQ ID NO: 1657 - DNA, 29 bp, Artificial Sequence
  source: /note="Description of Artificial Sequence: Synthetic primer"
tcctgaagggtacaaagtctctcgaaaag

SEQ ID NO: 1658 - DNA, 29 bp, Artificial Sequence
  source: /note="Description of Artificial Sequence: Synthetic primer"
ctctgagaggtatcatgtttcttgaaata

SEQ ID NO: 1659 - DNA, 29 bp, Artificial Sequence
  source: /note="Description of Artificial Sequence: Synthetic primer"
tcctgaggggtacagtgtctctagagaga

SEQ ID NO: 1660 - DNA, 29 bp, Artificial Sequence
  source: /note="Description of Artificial Sequence: Synthetic primer"
tatagctgaagggtacagcgtctctcggg

SEQ ID NO: 1661 - DNA, 29 bp, Artificial Sequence
  source: /note="Description of Artificial Sequence: Synthetic primer"
ctgaatgccccaacagctctctcttaaac

SEQ ID NO: 1662 - DNA, 29 bp, Artificial Sequence
  source: /note="Description of Artificial Sequence: Synthetic primer"
ctgaatgccccaacagctctcacttattc

SEQ ID NO: 1663 - DNA, 29 bp, Artificial Sequence
  source: /note="Description of Artificial Sequence: Synthetic primer"
cctgaatgccctgacagctctcgcttata

SEQ ID NO: 1664 - DNA, 29 bp, Artificial Sequence
  source: /note="Description of Artificial Sequence: Synthetic primer"
cctaaatctccagacaaagctcacttaaa

SEQ ID NO: 1665 - DNA, 28 bp, Artificial Sequence
  source: /note="Description of Artificial Sequence: Synthetic primer"
ctcacctgactctccagacaaagctcat

SEQ ID NO: 1666 - DNA, 29 bp, Artificial Sequence
  source: /note="Description of Artificial Sequence: Synthetic primer"
ttcagctaagtgcctcccaaattcaccct

SEQ ID NO: 1667 - DNA, 28 bp, Artificial Sequence
  source: /note="Description of Artificial Sequence: Synthetic primer"
gattctcatctcaatgccccaagaacgc

SEQ ID NO: 1668 - DNA, 29 bp, Artificial Sequence
  source: /note="Description of Artificial Sequence: Synthetic primer"
attttctgctgaatttcccaaagagggcc

SEQ ID NO: 1669 - DNA, 29 bp, Artificial Sequence
  source: /note="Description of Artificial Sequence: Synthetic primer"
attcacagctgaaagacctaacggaacgt

SEQ ID NO: 1670 - DNA, 29 bp, Artificial Sequence
  source: /note="Description of Artificial Sequence: Synthetic primer"
tcttagctgaaaggactggagggacgtat

SEQ ID NO: 1671 - DNA, 29 bp, Artificial Sequence
  source: /note="Description of Artificial Sequence: Synthetic primer"
ttcgatgatcaattctcagttgaaaggcc

SEQ ID NO: 1672 - DNA, 27 bp, Artificial Sequence
  source: /note="Description of Artificial Sequence: Synthetic primer"
ttgattctcagcacagatgcctgatgt

SEQ ID NO: 1673 - DNA, 27 bp, Artificial Sequence
  source: /note="Description of Artificial Sequence: Synthetic primer"
gcgattctcagctgagaggcctgatgg

SEQ ID NO: 1674 - DNA, 27 bp, Artificial Sequence
  source: /note="Description of Artificial Sequence: Synthetic primer"
tcgattctcagctaagatgcctaatgc

SEQ ID NO: 1675 - DNA, 30 bp, Artificial Sequence
  source: /note="Description of Artificial Sequence: Synthetic primer"
ttctcagcagagatgcctgatgcaacttta

SEQ ID NO: 1676 - DNA, 29 bp, Artificial Sequence
  source: /note="Description of Artificial Sequence: Synthetic primer"
ggttctctgcagagaggcctaagggatct

SEQ ID NO: 1677 - DNA, 29 bp, Artificial Sequence
  source: /note="Description of Artificial Sequence: Synthetic primer"
gctgcccagtgatcgcttctttgcagaaa

SEQ ID NO: 1678 - DNA, 29 bp, Artificial Sequence
  source: /note="Description of Artificial Sequence: Synthetic primer"
ggcggcccagtggtcggttctctgcagag

SEQ ID NO: 1679 - DNA, 30 bp, Artificial Sequence
  source: /note="Description of Artificial Sequence: Synthetic primer"
atgatcggttctctgcagagaggcctgagg

SEQ ID NO: 1680 - DNA, 29 bp, Artificial Sequence
  source: /note="Description of Artificial Sequence: Synthetic primer"
agtgatcgcttctctgcagagaggactgg

SEQ ID NO: 1681 - DNA, 28 bp, Artificial Sequence
  source: /note="Description of Artificial Sequence: Synthetic primer"
ggctgcccaacgatcggttctttgcagt

SEQ ID NO: 1682 - DNA, 29 bp, Artificial Sequence
  source: /note="Description of Artificial Sequence: Synthetic primer"
tccccgtgatcggttctctgcacagaggt

SEQ ID NO: 1683 - DNA, 29 bp, Artificial Sequence
  source: /note="Description of Artificial Sequence: Synthetic primer"
ctaaggatcgattttctgcagagaggctc

SEQ ID NO: 1684 - DNA, 29 bp, Artificial Sequence
  source: /note="Description of Artificial Sequence: Synthetic primer"
ctgatcgattctcagctcaacagttcagt

SEQ ID NO: 1685 - DNA, 29 bp, Artificial Sequence
  source: /note="Description of Artificial Sequence: Synthetic primer"
tggtcgattctcagggcgccagttctcta

SEQ ID NO: 1686 - DNA, 29 bp, Artificial Sequence
  source: /note="Description of Artificial Sequence: Synthetic primer"
taatcgattctcagggcgccagttccatg

SEQ ID NO: 1687 - DNA, 29 bp, Artificial Sequence
  source: /note="Description of Artificial Sequence: Synthetic primer"
tcctagattctcaggtctccagttcccta

SEQ ID NO: 1688 - DNA, 29 bp, Artificial Sequence
  source: /note="Description of Artificial Sequence: Synthetic primer"
ggaaacttccctcctagattttcaggtcg

SEQ ID NO: 1689 - DNA, 30 bp, Artificial Sequence
  source: /note="Description of Artificial Sequence: Synthetic primer"
aagaggaaacttccctgatcgattctcagc

SEQ ID NO: 1690 - DNA, 29 bp, Artificial Sequence
  source: /note="Description of Artificial Sequence: Synthetic primer"
ggcaacttccctgatcgattctcaggtca

SEQ ID NO: 1691 - DNA, 28 bp, Artificial Sequence
  source: /note="Description of Artificial Sequence: Synthetic primer"
gttccctgacttgcactctgaactaaac

SEQ ID NO: 1692 - DNA, 28 bp, Artificial Sequence
  source: /note="Description of Artificial Sequence: Synthetic primer"
gccgaacacttctttctgctttcttgac

SEQ ID NO: 1693 - DNA, 29 bp, Artificial Sequence
  source: /note="Description of Artificial Sequence: Synthetic primer"
gaccccaggaccggcagttcatcctgagt

SEQ ID NO: 1694 - DNA, 29 bp, Artificial Sequence
  source: /note="Description of Artificial Sequence: Synthetic primer"
atgcaagcctgaccttgtccactctgaca

SEQ ID NO: 1695 - DNA, 29 bp, Artificial Sequence
  source: /note="Description of Artificial Sequence: Synthetic primer"
catcagccgcccaaacctaacattctcaa

SEQ ID NO: 1696 - DNA, 33 bp, Artificial Sequence
  source: /note="Description of Artificial Sequence: Synthetic primer"
acaactgtgagtctggtgccttgtccaaagaaa

SEQ ID NO: 1697 - DNA, 33 bp, Artificial Sequence
  source: /note="Description of Artificial Sequence: Synthetic primer"
acaacggttaacctggtccccgaaccgaaggtg

SEQ ID NO: 1698 - DNA, 33 bp, Artificial Sequence
  source: /note="Description of Artificial Sequence: Synthetic primer"
acaacagtgagccaacttccctctccaaaatat

SEQ ID NO: 1699 - DNA, 33 bp, Artificial Sequence
  source: /note="Description of Artificial Sequence: Synthetic primer"
aagacagagagctgggttccactgccaaaaaac

SEQ ID NO: 1700 - DNA, 33 bp, Artificial Sequence
  source: /note="Description of Artificial Sequence: Synthetic primer"
aggatggagagtcgagtcccatcaccaaaatgc

SEQ ID NO: 1701 - DNA, 33 bp, Artificial Sequence
  source: /note="Description of Artificial Sequence: Synthetic primer"
gtcacagtgagcctggtcccgttcccaaagtgg

SEQ ID NO: 1702 - DNA, 33 bp, Artificial Sequence
  source: /note="Description of Artificial Sequence: Synthetic primer"
agcacggtgagccgtgtccctggcccgaagaac

SEQ ID NO: 1703 - DNA, 33 bp, Artificial Sequence
  source: /note="Description of Artificial Sequence: Synthetic primer"
agtacggtcagcctagagccttctccaaaaaac

SEQ ID NO: 1704 - DNA, 33 bp, Artificial Sequence
  source: /note="Description of Artificial Sequence: Synthetic primer"
agcactgtcagccgggtgcctgggccaaaatac

SEQ ID NO: 1705 - DNA, 33 bp, Artificial Sequence
  source: /note="Description of Artificial Sequence: Synthetic primer"
agcactgagagccgggtcccggcgccgaagtac

SEQ ID NO: 1706 - DNA, 33 bp, Artificial Sequence
  source: /note="Description of Artificial Sequence: Synthetic primer"
agcaccaggagccgcgtgcctggcccgaagtac

SEQ ID NO: 1707 - DNA, 33 bp, Artificial Sequence
  source: /note="Description of Artificial Sequence: Synthetic primer"
agcacggtcagcctgctgccggccccgaaagtc

SEQ ID NO: 1708 - DNA, 33 bp, Artificial Sequence
  source: /note="Description of Artificial Sequence: Synthetic primer"
gtgaccgtgagcctggtgcccggcccgaagtac

SEQ ID NO: 1709 - DNA, 33 bp, Artificial Sequence; identical to SEQ ID NO: 1708
  source: /note="Description of Artificial Sequence: Synthetic oligonucleotide"

SEQ ID NO: 1710 - DNA, 18 bp, Artificial Sequence
  source: /note="Description of Artificial Sequence: Synthetic primer"
aatacgactcactatagg

SEQ ID NO: 1711 - DNA, 19 bp, Artificial Sequence
  source: /note="Description of Artificial Sequence: Synthetic primer"
gctagttattgctcagcgg

SEQ ID NO: 1712 - DNA, 18 bp, Artificial Sequence
  source: /note="Description of Artificial Sequence: Synthetic primer"
attaaccctcactaaagg

SEQ ID NO: 1713 - DNA, 19 bp, Artificial Sequence
  source: /note="Description of Artificial Sequence: Synthetic primer"
gatttaggtgacactatag

SEQ ID NO: 1714 - DNA, 18 bp, Artificial Sequence
  source: /note="Description of Artificial Sequence: Synthetic primer"
tgtaaaacgacggccagt

SEQ ID NO: 1715 - DNA, 17 bp, Artificial Sequence
  source: /note="Description of Artificial Sequence: Synthetic primer"
gttttcccagtcacgac

SEQ ID NO: 1716 - DNA, 18 bp, Artificial Sequence
  source: /note="Description of Artificial Sequence: Synthetic primer"
caggaaacagctatgacc

SEQ ID NO: 1717 - DNA, 21 bp, Artificial Sequence
  source: /note="Description of Artificial Sequence: Synthetic primer"
gactggttccaattgacaagc

SEQ ID NO: 1718 - DNA, 21 bp, Artificial Sequence
  source: /note="Description of Artificial Sequence: Synthetic primer"
gcaaatggcattctgacatcc

SEQ ID NO: 1719 - DNA, 23 bp, Artificial Sequence
  source: /note="Description of Artificial Sequence: Synthetic primer"
gggctggcaagccacgtttggtg

SEQ ID NO: 1720 - DNA, 23 bp, Artificial Sequence
  source: /note="Description of Artificial Sequence: Synthetic primer"
ccgggagctgcatgtgtcagagg

SEQ ID NO: 1721 - DNA, 22 bp, Artificial Sequence
  source: /note="Description of Artificial Sequence: Synthetic primer"
aactagaaggcacagtcgaggc

SEQ ID NO: 1722 - DNA, 20 bp, Artificial Sequence
  source: /note="Description of Artificial Sequence: Synthetic primer"
cactctcggcatggacgagc

SEQ ID NO: 1723 - DNA, 20 bp, Artificial Sequence
  source: /note="Description of Artificial Sequence: Synthetic primer"
tggtgcagatgaacttcagg

SEQ ID NO: 1724 - DNA, 20 bp, Artificial Sequence
  source: /note="Description of Artificial Sequence: Synthetic primer"
gttcgaccccgcctcgatcc

SEQ ID NO: 1725 - DNA, 21 bp, Artificial Sequence
  source: /note="Description of Artificial Sequence: Synthetic primer"
tgacacacattccacagggtc

SEQ ID NO: 1726 - DNA, 19 bp, Artificial Sequence
  source: /note="Description of Artificial Sequence: Synthetic primer"
gcgtgaatgtaagcgtgac

SEQ ID NO: 1727 - DNA, 20 bp, Artificial Sequence
  source: /note="Description of Artificial Sequence: Synthetic primer"
ggattattcataccgtccca

SEQ ID NO: 1728 - DNA, 20 bp, Artificial Sequence
  source: /note="Description of Artificial Sequence: Synthetic primer"
caaatgtggtatggctgatt

SEQ ID NO: 1729 - DNA, 20 bp, Artificial Sequence
  source: /note="Description of Artificial Sequence: Synthetic primer"
atgccatagcatttttatcc

SEQ ID NO: 1730 - DNA, 18 bp, Artificial Sequence
  source: /note="Description of Artificial Sequence: Synthetic primer"
gatttaatctgtatcagg

SEQ ID NO: 1731 - DNA, 21 bp, Artificial Sequence
  source: /note="Description of Artificial Sequence: Synthetic primer"
cgcaaatgggcggtaggcgtg

SEQ ID NO: 1732 - DNA, 26 bp, Artificial Sequence
  source: /note="Description of Artificial Sequence: Synthetic primer"
ggaggggaaggccccacagtgtcttc

SEQ ID NO: 1733 - DNA, 26 bp, Artificial Sequence
  source: /note="Description of Artificial Sequence: Synthetic primer"
ggaggggaaggccccacagcgtcttc

SEQ ID NO: 1734 - DNA, 26 bp, Artificial Sequence
  source: /note="Description of Artificial Sequence: Synthetic primer"
ggaggggaagaccccacagcatcttc

SEQ ID NO: 1735 - DNA, 26 bp, Artificial Sequence
  source: /note="Description of Artificial Sequence: Synthetic primer"
ggaggggaaggccccacagcatcttc

SEQ ID NO: 1736 - DNA, 26 bp, Artificial Sequence
  source: /note="Description of Artificial Sequence: Synthetic primer"
ggcggggaaggccccacagcatcttc

SEQ ID NO: 1737 - DNA, 27 bp, Artificial Sequence
  source: /note="Description of Artificial Sequence: Synthetic primer"
tgaagtcatacagttcctggtgtccat

SEQ ID NO: 1738 - DNA, 28 bp, Artificial Sequence
  source: /note="Description of Artificial Sequence: Synthetic primer"
ccaaatcaggctttggagcacctgatct

SEQ ID NO: 1739 - DNA, 27 bp, Artificial Sequence
  source: /note="Description of Artificial Sequence: Synthetic primer"
caaaggcttagaatatttattacatgt

SEQ ID NO: 1740 - DNA, 27 bp, Artificial Sequence
  source: /note="Description of Artificial Sequence: Synthetic primer"
ccaggtccctgaggcactccaccagct

SEQ ID NO: 1741 - DNA, 28 bp, Artificial Sequence
  source: /note="Description of Artificial Sequence: Synthetic primer"
ctgaatctaaattatgagccatctgaca

SEQ ID NO: 1742 - DNA, 34 bp, Artificial Sequence
  source: /note="Description of Artificial Sequence: Synthetic primer"
gtgaagttactatgagcttagtcccttcagcaaa

SEQ ID NO: 1743 - DNA, 33 bp, Artificial Sequence
  source: /note="Description of Artificial Sequence: Synthetic primer"
cgaagttactatgagcctagtcccttttgcaaa

SEQ ID NO: 1744 - DNA, 28 bp, Artificial Sequence
  source: /note="Description of Artificial Sequence: Synthetic primer"
tgacaacaagtgttgttccactgccaaa

SEQ ID NO: 1745 - DNA, 31 bp, Artificial Sequence
  source: /note="Description of Artificial Sequence: Synthetic primer"
ctgtaatgataagctttgttccgggaccaaa

SEQ ID NO: 1746 - DNA, 19 bp, Artificial Sequence
  source: /note="Description of Artificial Sequence: Synthetic oligonucleotide"
gccttgccagcccgctcag

SEQ ID NO: 1747 - DNA, 49 bp, Artificial Sequence
  source: /note="Description of Artificial Sequence: Synthetic oligonucleotide"
caagcagaagacggcatacgagatcggtctgccttgccagcccgctcag

SEQ ID NO: 1748 - DNA, 16 bp, Artificial Sequence
  source: /note="Description of Artificial Sequence: Synthetic oligonucleotide"
acacacgtgacactct

SEQ ID NO: 1749 - DNA, 300 bp, Artificial Sequence
  source: /note="Description of Artificial Sequence: Synthetic polynucleotide"
tcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcag

SEQ ID NO: 1750 - DNA, 100 bp, Artificial Sequence
  source: /note="Description of Artificial Sequence: Synthetic polynucleotide"
actgaagctttctttggacaaggcaccagactcacagttgtaggtaagacatttttcaggttcttttgcagatccgtcacagggaaaagtgggtccacag

SEQ ID NO: 1751 - DNA, 19 bp, Artificial Sequence
  source: /note="Description of Artificial Sequence: Synthetic oligonucleotide"
ctgatggcgcgagggaggc

SEQ ID NO: 1752 - DNA, 48 bp, Artificial Sequence
  source: /note="Description of Artificial Sequence: Synthetic oligonucleotide"
aatgatacggcgaccaccgagatctacacgcctccctcgcgccatcag

SEQ ID NO: 1753 - DNA, 63 bp, Artificial Sequence
  source: /note="Description of Artificial Sequence: Synthetic primer"
caagcagaagacggcatacgagctcttccgatctaacaaaggagaagtctcagatggctacag

SEQ ID NO: 1754 - DNA, 63 bp, Artificial Sequence
  source: /note="Description of Artificial Sequence: Synthetic primer"
caagcagaagacggcatacgagctcttccgatctgataaaggagaagtccccgatggctatgt

SEQ ID NO: 1755 - DNA, 63 bp, Artificial Sequence
  source: /note="Description of Artificial Sequence: Synthetic primer"
caagcagaagacggcatacgagctcttccgatctgacaaaggagaagtctcagatggctatag

SEQ ID NO: 1756 - DNA, 63 bp, Artificial Sequence
  source: /note="Description of Artificial Sequence: Synthetic primer"
caagcagaagacggcatacgagctcttccgatctctaaggatcgattttctgcagagaggctc

SEQ ID NO: 1757 - DNA, 61 bp, Artificial Sequence
  source: /note="Description of Artificial Sequence: Synthetic primer"
caagcagaagacggcatacgagctcttccgatctttgattctcagcacagatgcctgatgt

SEQ ID NO: 1758 - DNA, 61 bp, Artificial Sequence
  source: /note="Description of Artificial Sequence: Synthetic primer"
caagcagaagacggcatacgagctcttccgatctgcgattctcagctgagaggcctgatgg

SEQ ID NO: 1759 - DNA, 61 bp, Artificial Sequence
  source: /note="Description of Artificial Sequence: Synthetic primer"
caagcagaagacggcatacgagctcttccgatcttcgattctcagctaagatgcctaatgc

SEQ ID NO: 1760 - DNA, 64 bp, Artificial Sequence
  source: /note="Description of Artificial Sequence: Synthetic primer"
caagcagaagacggcatacgagctcttccgatctttctcagcagagatgcctgatgcaacttta

SEQ ID NO: 1761 - DNA, 63 bp, Artificial Sequence
  source: /note="Description of Artificial Sequence: Synthetic primer"
caagcagaagacggcatacgagctcttccgatctctgatcgattctcagctcaacagttcagt

SEQ ID NO: 1762 - DNA, 63 bp, Artificial Sequence
  source: /note="Description of Artificial Sequence: Synthetic primer"
caagcagaagacggcatacgagctcttccgatcttcttagctgaaaggactggagggacgtat

SEQ ID NO: 1763 - DNA, 62 bp, Artificial Sequence
  source: /note="Description of Artificial Sequence: Synthetic primer"
caagcagaagacggcatacgagctcttccgatctgccgaacacttctttctgctttcttgac

SEQ ID NO: 1764 - DNA, 63 bp, Artificial Sequence
  source: /note="Description of Artificial Sequence: Synthetic primer"
caagcagaagacggcatacgagctcttccgatctttcagctaagtgcctcccaaattcaccct

SEQ ID NO: 1765 - DNA, 63 bp, Artificial Sequence
  source: /note="Description of Artificial Sequence: Synthetic primer"
caagcagaagacggcatacgagctcttccgatctattcacagctgaaagacctaacggaacgt

SEQ ID NO: 1766 - DNA, 63 bp, Artificial Sequence
  source: /note="Description of Artificial Sequence: Synthetic primer"
caagcagaagacggcatacgagctcttccgatctattttctgctgaatttcccaaagagggcc

SEQ ID NO: 1767 - DNA, 63 bp, Artificial Sequence
  source: /note="Description of Artificial Sequence: Synthetic primer"
caagcagaagacggcatacgagctcttccgatcttatagctgaagggtacagcgtctctcggg

SEQ ID NO: 1768 - DNA, 63 bp, Artificial Sequence
  source: /note="Description of Artificial Sequence: Synthetic primer"
caagcagaagacggcatacgagctcttccgatctttcgatgatcaattctcagttgaaaggcc

SEQ ID NO: 1769 - DNA, 63 bp, Artificial Sequence
  source: /note="Description of Artificial Sequence: Synthetic primer"
caagcagaagacggcatacgagctcttccgatctatgcaagcctgaccttgtccactctgaca

SEQ ID NO: 1770 - DNA, 62 bp, Artificial Sequence
  source: /note="Description of Artificial Sequence: Synthetic primer"
caagcagaagacggcatacgagctcttccgatctgattctcatctcaatgccccaagaacgc

SEQ ID NO: 1771 - DNA, 63 bp, Artificial Sequence
  source: /note="Description of Artificial Sequence: Synthetic primer"
caagcagaagacggcatacgagctcttccgatctatctctgatggatacagtgtctctcgaca

SEQ ID NO: 1772 - DNA, 63 bp, Artificial Sequence
  source: /note="Description of Artificial Sequence: Synthetic primer"
caagcagaagacggcatacgagctcttccgatcttttcctctgagtcaacagtctccagaata

SEQ ID NO: 1773 - DNA, 63 bp, Artificial Sequence
  source: /note="Description of Artificial Sequence: Synthetic primer"
caagcagaagacggcatacgagctcttccgatctctctgagaggtatcatgtttcttgaaata

SEQ ID NO: 1774 - DNA, 63 bp, Artificial Sequence
  source: /note="Description of Artificial Sequence: Synthetic primer"
caagcagaagacggcatacgagctcttccgatcttcctgaagggtacaaagtctctcgaaaag

SEQ ID NO: 1775 - DNA, 63 bp, Artificial Sequence
  source: /note="Description of Artificial Sequence: Synthetic primer"
caagcagaagacggcatacgagctcttccgatcttcctgaggggtacagtgtctctagagaga

SEQ ID NO: 1776 - DNA, 63 bp, Artificial Sequence
  source: /note="Description of Artificial Sequence: Synthetic primer"
caagcagaagacggcatacgagctcttccgatctcatcagccgcccaaacctaacattctcaa

SEQ ID NO: 1777 - DNA, 63 bp, Artificial Sequence
  source: /note="Description of Artificial Sequence: Synthetic primer"
caagcagaagacggcatacgagctcttccgatctcctgaatgccctgacagctctcgcttata

SEQ ID NO: 1778 - DNA, 63 bp, Artificial Sequence
  source: /note="Description of Artificial Sequence: Synthetic primer"
caagcagaagacggcatacgagctcttccgatctcctaaatctccagacaaagctcacttaaa

SEQ ID NO: 1779 - DNA, 62 bp, Artificial Sequence
  source: /note="Description of Artificial Sequence: Synthetic primer"
caagcagaagacggcatacgagctcttccgatctctcacctgactctccagacaaagctcat

SEQ ID NO: 1780 - DNA, 63 bp, Artificial Sequence
  source: /note="Description of Artificial Sequence: Synthetic primer"
caagcagaagacggcatacgagctcttccgatctgaccccaggaccggcagttcatcctgagt

SEQ ID NO: 1781 - DNA, 63 bp, Artificial Sequence
  source: /note="Description of Artificial Sequence: Synthetic primer"
caagcagaagacggcatacgagctcttccgatctctgaatgccccaacagctctctcttaaac

SEQ ID NO: 1782 - DNA, 63 bp, Artificial Sequence
  source: /note="Description of Artificial Sequence: Synthetic primer"
caagcagaagacggcatacgagctcttccgatctctgaatgccccaacagctctcacttattc

SEQ ID NO: 1783 - DNA, 63 bp, Artificial Sequence
  source: /note="Description of Artificial Sequence: Synthetic primer"
caagcagaagacggcatacgagctcttccgatcttggtcgattctcagggcgccagttctcta

SEQ ID NO: 1784 - DNA, 63 bp, Artificial Sequence
  source: /note="Description of Artificial Sequence: Synthetic primer"
caagcagaagacggcatacgagctcttccgatcttaatcgattctcagggcgccagttccatg

SEQ ID NO: 1785 - DNA, 63 bp, Artificial Sequence
  source: /note="Description of Artificial Sequence: Synthetic primer"
caagcagaagacggcatacgagctcttccgatcttcctagattctcaggtctccagttcccta

SEQ ID NO: 1786 - DNA, 64 bp, Artificial Sequence
  source: /note="Description of Artificial Sequence: Synthetic primer"
caagcagaagacggcatacgagctcttccgatctaagaggaaacttccctgatcgattctcagc

SEQ ID NO: 1787 - DNA, 63 bp, Artificial Sequence
  source: /note="Description of Artificial Sequence: Synthetic primer"
caagcagaagacggcatacgagctcttccgatctggcaacttccctgatcgattctcaggtca

SEQ ID NO: 1788 - DNA, 63 bp, Artificial Sequence
  source: /note="Description of Artificial Sequence: Synthetic primer"
caagcagaagacggcatacgagctcttccgatctggaaacttccctcctagattttcaggtcg

SEQ ID NO: 1789 - DNA, 63 bp, Artificial Sequence
  source: /note="Description of Artificial Sequence: Synthetic primer"
caagcagaagacggcatacgagctcttccgatctgtccccaatggctacaatgtctccagatt

SEQ ID NO: 1790 - DNA, 63 bp, Artificial Sequence
  source: /note="Description of Artificial Sequence: Synthetic primer"
caagcagaagacggcatacgagctcttccgatctgccaaaggagaggtccctgatggctacaa

SEQ ID NO: 1791 - DNA, 63 bp, Artificial Sequence
  source: /note="Description of Artificial Sequence: Synthetic primer"
caagcagaagacggcatacgagctcttccgatctgtccctgatggttatagtgtctccagagc

SEQ ID NO: 1792 - DNA, 63 bp, Artificial Sequence
  source: /note="Description of Artificial Sequence: Synthetic primer"
caagcagaagacggcatacgagctcttccgatctaaggagaagtccccaatggctacaatgtc

SEQ ID NO: 1793 - DNA, 64 bp, Artificial Sequence
  source: /note="Description of Artificial Sequence: Synthetic primer"
caagcagaagacggcatacgagctcttccgatctgacaaaggagaagtcccgaatggctacaac

SEQ ID NO: 1794 - DNA, 63 bp, Artificial Sequence
  source: /note="Description of Artificial Sequence: Synthetic primer"
caagcagaagacggcatacgagctcttccgatctgttcccaatggctacaatgtctccagatc

SEQ ID NO: 1795 - DNA, 63 bp, Artificial Sequence
  source: /note="Description of Artificial Sequence: Synthetic primer"
caagcagaagacggcatacgagctcttccgatctctctagattaaacacagaggatttcccac

SEQ ID NO: 1796 - DNA, 63 bp, Artificial Sequence
  source: /note="Description of Artificial Sequence: Synthetic primer"
caagcagaagacggcatacgagctcttccgatctaaggagaagtccccgatggctacaatgta

SEQ ID NO: 1797 - DNA, 63 bp, Artificial Sequence
  source: /note="Description of Artificial Sequence: Synthetic primer"
caagcagaagacggcatacgagctcttccgatcttccccgtgatcggttctctgcacagaggt

SEQ ID NO: 1798 - DNA, 63 bp, Artificial Sequence
  source: /note="Description of Artificial Sequence: Synthetic primer"
caagcagaagacggcatacgagctcttccgatctagtgatcgcttctctgcagagaggactgg

SEQ ID NO: 1799 - DNA, 62 bp, Artificial Sequence
  source: /note="Description of Artificial Sequence: Synthetic primer"
caagcagaagacggcatacgagctcttccgatctggctgcccaacgatcggttctttgcagt

SEQ ID NO: 1800 - DNA, 63 bp, Artificial Sequence
  source: /note="Description of Artificial Sequence: Synthetic primer"
caagcagaagacggcatacgagctcttccgatctggcggcccagtggtcggttctctgcagag

SEQ ID NO: 1801 - DNA, 64 bp, Artificial Sequence
  source: /note="Description of Artificial Sequence: Synthetic primer"
caagcagaagacggcatacgagctcttccgatctatgatcggttctctgcagagaggcctgagg

SEQ ID NO: 1802 - DNA, 63 bp, Artificial Sequence
  source: /note="Description of Artificial Sequence: Synthetic primer"
caagcagaagacggcatacgagctcttccgatctgctgcccagtgatcgcttctttgcagaaa

SEQ ID NO: 1803 - DNA, 63 bp, Artificial Sequence
  source: /note="Description of Artificial Sequence: Synthetic primer"
caagcagaagacggcatacgagctcttccgatctggttctctgcagagaggcctaagggatct

SEQ ID NO: 1804 - DNA, 62 bp, Artificial Sequence
  source: /note="Description of Artificial Sequence: Synthetic primer"
caagcagaagacggcatacgagctcttccgatctgttccctgacttgcactctgaactaaac

SEQ ID NO: 1805 - DNA, 495 bp, Artificial Sequence
  source: /note="Description of Artificial Sequence: Synthetic polynucleotide"
gcctccctcgcgccatcagagagtgtccttggttacttgcctggcccagtacacctggctccccgctatccccagacagcagactcacctgaggagacggtgaccagggtgccctggccccagtgctggaagtatgtcgacagagtgtccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccagagtgtccttggttactgagcgggctggcaaggc

SEQ ID NO: 1806 - DNA, 495 bp, Artificial Sequence
  source: /note="Description of Artificial Sequence: Synthetic polynucleotide"
gcctccctcgcgccatcagagagtgtcacctcttgcttgcctggcccagtacacctggctccccgctatccccagacagcagactcacctgaggagacggtgaccagggtgccctggccccagtgctggaagtatgtcgacagagtgtcacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccagagtgtcacctcttgctgagcgggctggcaaggc

SEQ ID NO: 1807 - DNA, 495 bp, Artificial Sequence
  source: /note="Description of Artificial Sequence: Synthetic polynucleotide"
gcctccctcgcgccatcagagagtgtcctgattctcttgcctggcccagtacacctggctccccgctatccccagacagcagactcacctgaggagacggtgaccagggtgccctggccccagtgctggaagtatgtcgacagagtgtcctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccagagtgtcctgattctctgagcgggctggcaaggc

SEQ ID NO: 1808 - DNA, 495 bp, Artificial Sequence
  source: /note="Description of Artificial Sequence: Synthetic polynucleotide"
gcctccctcgcgccatcagagagtgtcagtaccgacttgcctggcccagtacacctggctccccgctatccccagacagcagactcacctgaggagacggtgaccagggtgccctggccccagtgctggaagtatgtcgacagagtgtcagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccagagtgtcagtaccgactgagcgggctggcaaggc

SEQ ID NO: 1809 - DNA, 495 bp, Artificial Sequence
  source: /note="Description of Artificial Sequence: Synthetic polynucleotide"
gcctccctcgcgccatcagagagtgtcatccatggcttgcctggcccagtacacctggctccccgctatccccagacagcagactcacctgaggagacggtgaccagggtgccctggccccagtgctggaagtatgtcgacagagtgtcatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccagagtgtcatccatggctgagcgggctggcaaggc

SEQ ID NO: 1810 - DNA, 495 bp, Artificial Sequence
  source: /note="Description of Artificial Sequence: Synthetic polynucleotide"
gcctccctcgcgccatcagagagtgtcgtagcagtcttgcctggcccagtacacctggctccccgctatccccagacagcagactcacctgaggagacggtgaccagggtgccctggccccagtgctggaagtatgtcgacagagtgtcgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcagagtgtcgtagcagtctgagcgggctggcaaggc

SEQ ID NO: 1811 - DNA, 495 bp, Artificial Sequence
  source: /note="Description of Artificial Sequence: Synthetic polynucleotide"
gcctccctcgcgccatcagagagtgtcatcttcgtcttgcctggcccagtacacctggctccccgctatccccagacagcagactcacctgaggagacggtgaccagggtgccctggccccagtgctggaagtatgtcgacagagtgtcatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccagagtgtcatcttcgtctgagcgggctggcaaggc

SEQ ID NO: 1812 - DNA, 495 bp, Artificial Sequence
  source: /note="Description of Artificial Sequence: Synthetic polynucleotide"
gcctccctcgcgccatcagagagtgtctccacagtcttgcctggcccagtacacctggctccccgctatccccagacagcagactcacctgaggagacggtgaccagggtgccctggccccagtgctggaagtatgtcgacagagtgtctccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccagagtgtctccacagtctgagcgggctggcaaggc

SEQ ID NO: 1813 - DNA, 495 bp, Artificial Sequence
  source: /note="Description of Artificial Sequence: Synthetic polynucleotide"
gcctccctcgcgccatcagagagtgtcagctagtgcttgcctggcccagtacacctggctccccgctatccccagacagcagactcacctgaggagacggtgaccagggtgccctggccccagtgctggaagtatgtcgacagagtgtcagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccagagtgtcagctagtgctgagcgggctggcaaggc

SEQ ID NO: 1814 - DNA, 495 bp, Artificial Sequence
  source: /note="Description of Artificial Sequence: Synthetic polynucleotide"
gcctccctcgcgccatcagagagtgtctaaccaagcttgcctggcccagtacacctggctccccgctatccccagacagcagactcacctgaggagacggtgaccagggtgccctggccccagtgctggaagtatgtcgacagagtgtctaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccagagtgtctaaccaagctgagcgggctggcaaggc

SEQ ID NO: 1815 - DNA, 495 bp, Artificial Sequence
  source: /note="Description of Artificial Sequence: Synthetic polynucleotide"
gcctccctcgcgccatcagagagtgtccaagaggtcttgcctggcccagtacacctggctccccgctatccccagacagcagactcacctgaggagacggtgaccagggtgccctggccccagtgctggaagtatgtcgacagagtgtccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccagagtgtccaagaggtctgagcgggctggcaaggc

SEQ ID NO: 1816 - DNA, 495 bp, Artificial Sequence
  source: /note="Description of Artificial Sequence: Synthetic polynucleotide"
gcctccctcgcgccatcagagagtgtcagttgacccttgcctggcccagtacacctggctccccgctatccccagacagcagactcacctgaggagacggtgaccagggtgccctggccccagtgctggaagtatgtcgacagagtgtcagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaagagtgtcagttgaccctgagcgggctggcaaggc

SEQ ID NO: 1817 - DNA, 495 bp, Artificial Sequence
  source: /note="Description of Artificial Sequence: Synthetic polynucleotide"
gcctccctcgcgccatcagagagtgtccagcatatcttgcctggcccagtacacctggctccccgctatccccagacagcagactcacctgaggagacggtgaccagggtgccctggccccagtgctggaagtatgtcgacagagtgtccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaagagtgtccagcatatctgagcgggctggcaaggc

SEQ ID NO: 1818 - DNA, 495 bp, Artificial Sequence
  source: /note="Description of Artificial Sequence: Synthetic polynucleotide"
gcctccctcgcgccatcagagagtgtcgcaggattcttgcctggcccagtacacctggctccccgctatccccagacagcagactcacctgaggagacggtgaccagggtgccctggccccagtgctggaagtatgtcgacagagtgtcgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaagagtgtcgcaggattctgagcgggctggcaaggc

SEQ ID NO: 1819 - DNA, 495 bp, Artificial Sequence
  source: /note="Description of Artificial Sequence: Synthetic polynucleotide"
gcctccctcgcgccatcagagagtgtcgtccattccttgcctggcccagtacacctggctccccgctatccccagacagcagactcacctgaggagacggtgaccagggtgccctggccccagtgctggaagtatgtcgacagagtgtcgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccagagtgtcgtccattcctgagcgggctggcaaggc

SEQ ID NO: 1820 - DNA, 495 bp, Artificial Sequence
  source: /note="Description of Artificial Sequence: Synthetic polynucleotide"
gcctccctcgcgccatcagagagtgtcgcataactcttgcctggcccagtacacctggctccccgctatccccagacagcagactcacctgaggagacggtgaccagggtgccctggccccagtgctggaagtatgtcgacagagtgtcgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacagagtgtcgcataactctgagcgggctggcaaggc

SEQ ID NO: 1821 - DNA, 495 bp, Artificial Sequence
  source: /note="Description of Artificial Sequence: Synthetic polynucleotide"
gcctccctcgcgccatcagagagtgtcatatgctgcttgcctggcccagtacacctggctccccgctatccccagacagcagactcacctgaggagacggtgaccagggtgccctggccccagtgctggaagtatgtcgacagagtgtcatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccagagtgtcatatgctgctgagcgggctggcaaggc

SEQ ID NO: 1822 - DNA, 495 bp, Artificial Sequence
  source: /note="Description of Artificial Sequence: Synthetic polynucleotide"
gcctccctcgcgccatcagagagtgtcaatcctgccttgcctggcccagtacacctggctccccgctatccccagacagcagactcacctgaggagacggtgaccagggtgccctggccccagtgctggaagtatgtcgacagagtgtcaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcagagtgtcaatcctgcctgagcgggctggcaaggc

SEQ ID NO: 1823 - DNA, 495 bp, Artificial Sequence
  source: /note="Description of Artificial Sequence: Synthetic polynucleotide"
gcctccctcgcgccatcagagagtgtctgagacctcttgcctggcccagtacacctggctccccgctatccccagacagcagactcacctgaggagacggtgaccagggtgccctggccccagtgctggaagtatgtcgacagagtgtctgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgagagtgtctgagacctctgagcgggctggcaaggc

SEQ ID NO: 1824 - DNA, 495 bp, Artificial Sequence
  source: /note="Description of Artificial Sequence: Synthetic polynucleotide"
gcctccctcgcgccatcagagagtgtcgaatggaccttgcctggcccagtacacctggctccccgctatccccagacagcagactcacctgaggagacggtgaccagggtgccctggccccagtgctggaagtatgtcgacagagtgtcgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccagagtgtcgaatggacctgagcgggctggcaaggc

SEQ ID NO: 1825 - DNA, 495 bp, Artificial Sequence
  source: /note="Description of Artificial Sequence: Synthetic polynucleotide"
gcctccctcgcgccatcagagagtgtccacatggacttgcctggcccagtacacctggctccccgctatccccagacagcagactcacctgaggagacggtgaccagggtgccctggccccagtgctggaagtatgtcgacagagtgtccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccagagtgtccacatggactgagcgggctggcaaggc

SEQ ID NO: 1826 - DNA, 495 bp, Artificial Sequence
  source: /note="Description of Artificial Sequence: Synthetic polynucleotide"
gcctccctcgcgccatcagagagtgtcttgaccatcttgcctggcccagtacacctggctccccgctatccccagacagcagactcacctgaggagacggtgaccagggtgccctggccccagtgctggaagtatgtcgacagagtgtcttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccagagtgtcttgaccatctgagcgggctggcaaggc

SEQ ID NO: 1827 - DNA, 495 bp, Artificial Sequence
  source: /note="Description of Artificial Sequence: Synthetic polynucleotide"
gcctccctcgcgccatcagagagtgtcaagccatccttgcctggcccagtacacctggctccccgctatccccagacagcagactcacctgaggagacggtgaccagggtgccctggccccagtgctggaagtatgtcgacagagtgtcaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccagagtgtcaagccatcctgagcgggctggcaaggc

SEQ ID NO: 1828 - DNA, 495 bp, Artificial Sequence
  source: /note="Description of Artificial Sequence: Synthetic polynucleotide"
gcctccctcgcgccatcagagagtgtctccatgtgcttgcctggcccagtacacctggctccccgctatccccagacagcagactcacctgaggagacggtgaccagggtgccctggccccagtgctggaagtatgtcgacagagtgtctccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtctccatgtgctgagcgggctggcaaggc

SEQ ID NO: 1829 - DNA, 495 bp, Artificial Sequence
  source: /note="Description of Artificial Sequence: Synthetic polynucleotide"
gcctccctcgcgccatcagagagtgtccaagtcaccttgcctggcccagtacacctggctccccgctatccccagacagcagactcacctgaggagacggtgaccagggtgccctggccccagtgctggaagtatgtcgacagagtgtccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtccaagtcacctgagcgggctggcaaggc

SEQ ID NO: 1830 - DNA, 495 bp, Artificial Sequence
  source: /note="Description of Artificial Sequence: Synthetic polynucleotide"
gcctccctcgcgccatcagagagtgtcctgcaatccttgcctggcccagtacacctggctccccgctatccccagacagcagactcacctgaggagacggtgaccagggtgccctggccccagtgctggaagtatgtcgacagagtgtcctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccagagtgtcctgcaatcctgagcgggctggcaaggc

SEQ ID NO: 1831 - DNA, 495 bp, Artificial Sequence
  source: /note="Description of Artificial Sequence: Synthetic polynucleotide"
gcctccctcgcgccatcagagagtgtcatcgacgacttgcctggcccagtacacctggctccccgctatccccagacagcagactcacctgaggagacggtgaccagggtgccctggccccagtgctggaagtatgtcgacagagtgtcatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccagagtgtcatcgacgactgagcgggctggcaaggc

SEQ ID NO: 1832 - DNA, 495 bp, Artificial Sequence
  source: /note="Description of Artificial Sequence: Synthetic polynucleotide"
gcctccctcgcgccatcagagagtgtcacagactgcttgcctggcccagtacacctggctccccgctatccccagacagcagactcacctgaggagacggtgaccagggtgccctggccccagtgctggaagtatgtcgacagagtgtcacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaagagtgtcacagactgctgagcgggctggcaaggc

SEQ ID NO: 1833 - DNA, 495 bp, Artificial Sequence
  source: /note="Description of Artificial Sequence: Synthetic polynucleotide"
gcctccctcgcgccatcagagagtgtcccttatagcttgcctggcccagtacacctggctccccgctatccccagacagcagactcacctgaggagacggtgaccagggtgccctggccccagtgctggaagtatgtcgacagagtgtcccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacagagtgtcccttatagctgagcgggctggcaaggc

SEQ ID NO: 1834 - DNA, 495 bp, Artificial Sequence
  source: /note="Description of Artificial Sequence: Synthetic polynucleotide"
gcctccctcgcgccatcagagagtgtctacgcgttcttgcctggcccagtacacctggctccccgctatccccagacagcagactcacctgaggagacggtgaccagggtgccctggccccagtgctggaagtatgtcgacagagtgtctacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccagagtgtctacgcgttctgagcgggctggcaaggc

SEQ ID NO: 1835 - DNA, 495 bp, Artificial Sequence
  source: /note="Description of Artificial Sequence: Synthetic polynucleotide"
gcctccctcgcgccatcagagagtgtcctataaggcttgcctggcccagtacacctggctccccgctatccccagacagcagactcacctgaggagacggtgaccagggtgccctggccccagtgctggaagtatgtcgacagagtgtcctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgagagtgtcctataaggctgagcgggctggcaaggc

SEQ ID NO: 1836 - DNA, 495 bp, Artificial Sequence
  source: /note="Description of Artificial Sequence: Synthetic polynucleotide"
gcctccctcgcgccatcagagagtgtctcttagtccttgcctggcccagtacacctggctccccgctatccccagacagcagactcacctgaggagacggtgaccagggtgccctggccccagtgctggaagtatgtcgacagagtgtctcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtctcttagtcctgagcgggctggcaaggc

SEQ ID NO: 1837 - DNA, 495 bp, Artificial Sequence
  source: /note="Description of Artificial Sequence: Synthetic polynucleotide"
gcctccctcgcgccatcagagagtgtctgtctgcacttgcctggcccagtacacctggctccccgctatccccagacagcagactcacctgaggagacggtgaccagggtgccctggccccagtgctggaagtatgtcgacagagtgtctgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccagagtgtctgtctgcactgagcgggctggcaaggc

SEQ ID NO: 1838 - DNA, 495 bp, Artificial Sequence
  source: /note="Description of Artificial Sequence: Synthetic polynucleotide"
gcctccctcgcgccatcagagagtgtcgccattaacttgcctggcccagtacacctggctccccgctatccccagacagcagactcacctgaggagacggtgaccagggtgccctggccccagtgctggaagtatgtcgacagagtgtcgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtcgccattaactgagcgggctggcaaggc

SEQ ID NO: 1839 - DNA, 495 bp, Artificial Sequence
  source: /note="Description of Artificial Sequence: Synthetic polynucleotide"
gcctccctcgcgccatcagagagtgtcgactaagacttgcctggcccagtacacctggctccccgctatccccagacagcagactcacctgaggagacggtgaccagggtgccctggccccagtgctggaagtatgtcgacagagtgtcgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgagagtgtcgactaagactgagcgggctggcaaggc

SEQ ID NO: 1840 - DNA, 495 bp, Artificial Sequence
  source: /note="Description of Artificial Sequence: Synthetic polynucleotide"
gcctccctcgcgccatcagagagtgtcaggttgctcttgcctggcccagtacacctggctccccgctatccccagacagcagactcacctgaggagacggtgaccagggtgccctggccccagtgctggaagtatgtcgacagagtgtcaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgagagtgtcaggttgctctgagcgggctggcaaggc

SEQ ID NO: 1841 - DNA, 495 bp, Artificial Sequence
  source: /note="Description of Artificial Sequence: Synthetic polynucleotide"
gcctccctcgcgccatcagagagtgtcctcgagaacttgcctggcccagtacacctggctccccgctatccccagacagcagactcacctgaggagacggtgaccagggtgccctggccccagtgctggaagtatgtcgacagagtgtcctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccagagtgtcctcgagaactgagcgggctggcaaggc

SEQ ID NO: 1842 - DNA, 495 bp, Artificial Sequence
  source: /note="Description of Artificial Sequence: Synthetic polynucleotide"
gcctccctcgcgccatcagagagtgtcttaatggccttgcctggcccagtacacctggctccccgctatccccagacagcagactcacctgaggagacggtgaccagggtgccctggccccagtgctggaagtatgtcgacagagtgtcttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccagagtgtcttaatggcctgagcgggctggcaaggc

SEQ ID NO: 1843 - DNA, 495 bp, Artificial Sequence
  source: /note="Description of Artificial Sequence: Synthetic polynucleotide"
gcctccctcgcgccatcagagagtgtctgcagacacttgcctggcccagtacacctggctccccgctatccccagacagcagactcacctgaggagacggtgaccagggtgccctggccccagtgctggaagtatgtcgacagagtgtctgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaagagtgtctgcagacactgagcgggctggcaaggc

SEQ ID NO: 1844 - DNA, 495 bp, Artificial Sequence
  source: /note="Description of Artificial Sequence: Synthetic polynucleotide"
gcctccctcgcgccatcagagagtgtctcactgagcttgcctggcccagtacacctggctccccgctatccccagacagcagactcacctgaggagacggtgaccagggtgccctggccccagtgctggaagtatgtcgacagagtgtctcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtagagtgtctcactgagctgagcgggctggcaaggc

SEQ ID NO: 1845 - DNA, 495 bp, Artificial Sequence
  source: /note="Description of Artificial Sequence: Synthetic polynucleotide"
gcctccctcgcgccatcagagagtgtcgagtacgtcttgcctggcccagtacacctggctccccgctatccccagacagcagactcacctgaggagacggtgaccagggtgccctggccccagtgctggaagtatgtcgacagagtgtcgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacagagtgtcgagtacgtctgagcgggctggcaaggc

SEQ ID NO: 1846 - DNA, 495 bp, Artificial Sequence
  source: /note="Description of Artificial Sequence: Synthetic polynucleotide"
gcctccctcgcgccatcagagagtgtcatacgccacttgcctggcccagtacacctggctccccgctatccccagacagcagactcacctgaggagacggtgaccagggtgccctggccccagtgctggaagtatgtcgacagagtgtcatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacagagtgtcatacgccactgagcgggctggcaaggc

SEQ ID NO: 1847 - DNA, 495 bp, Artificial Sequence
  source: /note="Description of Artificial Sequence: Synthetic polynucleotide"
gcctccctcgcgccatcagagagtgtctcgcatcacttgcctggcccagtacacctggctccccgctatccccagacagcagactcacctgaggagacggtgaccagggtgccctggccccagtgctggaagtatgtcgacagagtgtctcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacagagtgtctcgcatcactgagcgggctggcaaggc

SEQ ID NO: 1848 - DNA, 495 bp, Artificial Sequence
  source: /note="Description of Artificial Sequence: Synthetic polynucleotide"
gcctccctcgcgccatcagagagtgtccgcttaatcttgcctggcccagtacacctggctccccgctatccccagacagcagactcacctgaggagacggtgaccagggtgccctggccccagtgctggaagtatgtcgacagagtgtccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacagagtgtccgcttaatctgagcgggctggcaaggc

SEQ ID NO: 1849 - DNA, 495 bp, Artificial Sequence
  source: /note="Description of Artificial Sequence: Synthetic polynucleotide"
gcctccctcgcgccatcagagagtgtctggttatccttgcctggcccagtacacctggctccccgctatccccagacagcagactcacctgaggagacggtgaccagggtgccctggccccagtgctggaagtatgtcgacagagtgtctggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtagagtgtctggttatcctgagcgggctggcaaggc

SEQ ID NO: 1850 - DNA, 495 bp, Artificial Sequence
  source: /note="Description of Artificial Sequence: Synthetic polynucleotide"
gcctccctcgcgccatcagagagtgtcggattgctcttgcctggcccagtacacctggctccccgctatccccagacagcagactcacctgaggagacggtgaccagggtgccctggccccagtgctggaagtatgtcgacagagtgtcggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacagagtgtcggattgctctgagcgggctggcaaggc

SEQ ID NO: 1851 - DNA, 495 bp, Artificial Sequence
  source: /note="Description of Artificial Sequence: Synthetic polynucleotide"
gcctccctcgcgccatcagagagtgtcctcagtgacttgcctggcccagtacacctggctccccgctatccccagacagcagactcacctgaggagacggtgaccagggtgccctggccccagtgctggaagtatgtcgacagagtgtcctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtagagtgtcctcagtgactgagcgggctggcaaggc

SEQ ID NO: 1852 - DNA, 495 bp, Artificial Sequence
  source: /note="Description of Artificial Sequence: Synthetic polynucleotide"
gcctccctcgcgccatcagagagtgtcacgtactccttgcctggcccagtacacctggctccccgctatccccagacagcagactcacctgaggagacggtgaccagggtgccctggccccagtgctggaagtatgtcgacagagtgtcacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacagagtgtcacgtactcctgagcgggctggcaaggc

SEQ ID NO: 1853 - DNA, 495 bp, Artificial Sequence
  source: /note="Description of Artificial Sequence: Synthetic polynucleotide"
gcctccctcgcgccatcagagagtgtctgatgcgacttgcctggcccagtacacctggctccccgctatccccagacagcagactcacctgaggagacggtgaccagggtgccctggccccagtgctggaagtatgtcgacagagtgtctgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccagagtgtctgatgcgactgagcgggctggcaaggc

SEQ ID NO: 1854 - DNA, 495 bp, Artificial Sequence
  source: /note="Description of Artificial Sequence: Synthetic polynucleotide"
gcctccctcgcgccatcagagagtgtcattaagcgcttgcctggcccagtacacctggctccccgctatccccagacagcagactcacctgaggagacggtgaccagggtgccctggccccagtgctggaagtatgtcgacagagtgtcattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccagagtgtcattaagcgctgagcgggctggcaaggc

SEQ ID NO: 1855 - DNA, 495 bp, Artificial Sequence
  source: /note="Description of Artificial Sequence: Synthetic polynucleotide"
gcctccctcgcgccatcagagagtgtcagcaatcccttgcctggcccagtacacctggctccccgctatccccagacagcagactcacctgaggagacggtgaccagggtgccctggccccagtgctggaagtatgtcgacagagtgtcagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccagagtgtcagcaatccctgagcgggctggcaaggc

SEQ ID NO: 1856 - DNA, 495 bp, Artificial Sequence
  source: /note="Description of Artificial Sequence: Synthetic polynucleotide"
gcctccctcgcgccatcagagagtgtcgcttagtacttgcctggcccagtacacctggctccccgctatccccagacagcagactcacctgaggagacggtgaccagggtgccctggccccagtgctggaagtatgtcgacagagtgtcgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaagagtgtcgcttagtactgagcgggctggcaaggc

SEQ ID NO: 1857 - DNA, 495 bp, Artificial Sequence
  source: /note="Description of Artificial Sequence: Synthetic polynucleotide"
gcctccctcgcgccatcagagagtgtctgaccttgcttgcctggcccagtacacctggctccccgctatccccagacagcagactcacctgaggagacggtgaccagggtgccctggccccagtgctggaagtatgtcgacagagtgtctgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccagagtgtctgaccttgctgagcgggctggcaaggc

SEQ ID NO: 1858 - DNA, 495 bp, Artificial Sequence
  source: /note="Description of Artificial Sequence: Synthetic polynucleotide"
gcctccctcgcgccatcagagagtgtccaaggtcacttgcctggcccagtacacctggctccccgctatccccagacagcagactcacctgaggagacggtgaccagggtgccctggccccagtgctggaagtatgtcgacagagtgtccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccagagtgtccaaggtcactgagcgggctggcaaggc

SEQ ID NO: 1859 - DNA, 495 bp, Artificial Sequence
  source: /note="Description of Artificial Sequence: Synthetic polynucleotide"
gcctccctcgcgccatcagagagtgtccactgtaccttgcctggcccagtacacctggctccccgctatccccagacagcagactcacctgaggagacggtgaccagggtgccctggccccagtgctggaagtatgtcgacagagtgtccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcagagtgtccactgtacctgagcgggctggcaaggc

SEQ ID NO: 1860 - DNA, 495 bp, Artificial Sequence
  source: /note="Description of Artificial Sequence: Synthetic polynucleotide"
gcctccctcgcgccatcagagagtgtcgatgatcccttgcctggcccagtacacctggctccccgctatccccagacagcagactcacctgaggagacggtgaccagggtgccctggccccagtgctggaagtatgtcgacagagtgtcgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggagagtgtcgatgatccctgagcgggctggcaaggc

SEQ ID NO: 1861 - DNA, 495 bp, Artificial Sequence
  source: /note="Description of Artificial Sequence: Synthetic polynucleotide"
gcctccctcgcgccatcagagagtgtccgccaatacttgcctggcccagtacacctggctccccgctatccccagacagcagactcacctgaggagacggtgaccagggtgccctggccccagtgctggaagtatgtcgacagagtgtccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggagagtgtccgccaatactgagcgggctggcaaggc

SEQ ID NO: 1862 - DNA, 495 bp, Artificial Sequence
  source: /note="Description of Artificial Sequence: Synthetic polynucleotide"
gcctccctcgcgccatcagagagtgtctcaagcctcttgcctggcccagtacacctggctccccgctatccccagacagcagactcacctgaggagacggtgaccagggtgccctggccccagtgctggaagtatgtcgacagagtgtctcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaagagtgtctcaagcctctgagcgggctggcaaggc

SEQ ID NO: 1863 - DNA, 495 bp, Artificial Sequence
  source: /note="Description of Artificial Sequence: Synthetic polynucleotide"
gcctccctcgcgccatcagagagtgtcacgtgtgtcttgcctggcccagtacacctggctccccgctatccccagacagcagactcacctgaggagacggtgaccagggtgccctggccccagtgctggaagtatgtcgacagagtgtcacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagagagtgtcacgtgtgtctgagcgggctggcaaggc

SEQ ID NO: 1864 - DNA, 495 bp, Artificial Sequence
  source: /note="Description of Artificial Sequence: Synthetic polynucleotide"
gcctccctcgcgccatcagagagtgtctccgtctacttgcctggcccagtacacctggctccccgctatccccagacagcagactcacctgaggagacggtgaccagggtgccctggccccagtgctggaagtatgtcgacagagtgtctccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagagagtgtctccgtctactgagcgggctggcaaggc

SEQ ID NO: 1865 - DNA, 495 bp, Artificial Sequence
  source: /note="Description of Artificial Sequence: Synthetic polynucleotide"
gcctccctcgcgccatcagagagtgtcaagagctgcttgcctggcccagtacacctggctccccgctatccccagacagcagactcacctgaggagacggtgaccagggtgccctggccccagtgctggaagtatgtcgacagagtgtcaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgagagtgtcaagagctgctgagcgggctggcaaggc

SEQ ID NO: 1866 - DNA, 495 bp, Artificial Sequence
  source: /note="Description of Artificial Sequence: Synthetic polynucleotide"
gcctccctcgcgccatcagagagtgtctatcgctccttgcctggcccagtacacctggctccccgctatccccagacagcagactcacctgaggagacggtgaccagggtgccctggccccagtgctggaagtatgtcgacagagtgtctatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagagagtgtctatcgctcctgagcgggctggcaaggc

SEQ ID NO: 1867 - DNA, 495 bp, Artificial Sequence
  source: /note="Description of Artificial Sequence: Synthetic polynucleotide"
gcctccctcgcgccatcagagagtgtctcagatgccttgcctggcccagtacacctggctccccgctatccccagacagcagactcacctgaggagacggtgaccagggtgccctggccccagtgctggaagtatgtcgacagagtgtctcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccagagtgtctcagatgcctgagcgggctggcaaggc

SEQ ID NO: 1868 - DNA, 495 bp, Artificial Sequence
  source: /note="Description of Artificial Sequence: Synthetic polynucleotide"
gcctccctcgcgccatcagagagtgtcgtgtagcacttgcctggcccagtacacctggctccccgctatccccagacagcagactcacctgaggagacggtgaccagggtgccctggccccagtgctggaagtatgtcgacagagtgtcgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgagagtgtcgtgtagcactgagcgggctggcaaggc

SEQ ID NO: 1869 - DNA, 495 bp, Artificial Sequence
  source: /note="Description of Artificial Sequence: Synthetic polynucleotide"
gcctccctcgcgccatcagagagtgtctggcagttcttgcctggcccagtacacctggctccccgctatccccagacagcagactcacctgaggagacggtgaccagggtgccctggccccagtgctggaagtatgtcgacagagtgtctggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgagagtgtctggcagttctgagcgggctggcaaggc

SEQ ID NO: 1870 - DNA, 495 bp, Artificial Sequence
  source: /note="Description of Artificial Sequence: Synthetic polynucleotide"
gcctccctcgcgccatcagagagtgtccagtccaacttgcctggcccagtacacctggctccccgctatccccagacagcagactcacctgaggagacggtgaccagggtgccctggccccagtgctggaagtatgtcgacagagtgtccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacagagtgtccagtccaactgagcgggctggcaaggc

SEQ ID NO: 1871 - DNA, 495 bp, Artificial Sequence
  source: /note="Description of Artificial Sequence: Synthetic polynucleotide"
gcctccctcgcgccatcagagagtgtcgtgtctaccttgcctggcccagtacacctggctccccgctatccccagacagcagactcacctgaggagacggtgaccagggtgccctggccccagtgctggaagtatgtcgacagagtgtcgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggagagtgtcgtgtctacctgagcgggctggcaaggc

SEQ ID NO: 1872 - DNA, 495 bp, Artificial Sequence
  source: /note="Description of Artificial Sequence: Synthetic polynucleotide"
gcctccctcgcgccatcagagagtgtcgtacagtgcttgcctggcccagtacacctggctccccgctatccccagacagcagactcacctgaggagacggtgaccagggtgccctggccccagtgctggaagtatgtcgacagagtgtcgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagagagtgtcgtacagtgctgagcgggctggcaaggc

SEQ ID NO: 1873 - DNA, 495 bp, Artificial Sequence
  source: /note="Description of Artificial Sequence: Synthetic polynucleotide"
gcctccctcgcgccatcagagagtgtcggatcatccttgcctggcccagtacacctggctccccgctatccccagacagcagactcacctgaggagacggtgaccagggtgccctggccccagtgctggaagtatgtcgacagagtgtcggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagagagtgtcggatcatcctgagcgggctggcaaggc

SEQ ID NO: 1874 - DNA, 495 bp, Artificial Sequence
  source: /note="Description of Artificial Sequence: Synthetic polynucleotide"
gcctccctcgcgccatcagagagtgtctattggcgcttgcctggcccagtacacctggctccccgctatccccagacagcagactcacctgaggagacggtgaccagggtgccctggccccagtgctggaagtatgtcgacagagtgtctattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaagagtgtctattggcgctgagcgggctggcaaggc

SEQ ID NO: 1875 - DNA, 495 bp, Artificial Sequence
  source: /note="Description of Artificial Sequence: Synthetic polynucleotide"
gcctccctcgcgccatcagagagtgtcaggcttgacttgcctggcccagtacacctggctccccgctatccccagacagcagactcacctgaggagacggtgaccagggtgccctggccccagtgctggaagtatgtcgacagagtgtcaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacagagtgtcaggcttgactgagcgggctggcaaggc

SEQ ID NO: 1876 - DNA, 495 bp, Artificial Sequence
  source: /note="Description of Artificial Sequence: Synthetic polynucleotide"
gcctccctcgcgccatcagagagtgtcacacacgtcttgcctggcccagtacacctggctccccgctatccccagacagcagactcacctgaggagacggtgaccagggtgccctggccccagtgctggaagtatgtcgacagagtgtcacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatagagtgtcacacacgtctgagcgggctggcaaggc

SEQ ID NO: 1877 - DNA, 495 bp, Artificial Sequence
  source: /note="Description of Artificial Sequence: Synthetic polynucleotide"
gcctccctcgcgccatcagagagtgtctagacggacttgcctggcccagtacacctggctccccgctatccccagacagcagactcacctgaggagacggtgaccagggtgccctggccccagtgctggaagtatgtcgacagagtgtctagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaagagtgtctagacggactgagcgggctggcaaggc

SEQ ID NO: 1878 - DNA, 495 bp, Artificial Sequence
  source: /note="Description of Artificial Sequence: Synthetic polynucleotide"
gcctccctcgcgccatcagagagtgtcgagcgatacttgcctggcccagtacacctggctccccgctatccccagacagcagactcacctgaggagacggtgaccagggtgccctggccccagtgctggaagtatgtcgacagagtgtcgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttagagtgtcgagcgatactgagcgggctggcaaggc

SEQ ID NO: 1879 - DNA, 495 bp, Artificial Sequence
  source: /note="Description of Artificial Sequence: Synthetic polynucleotide"
gcctccctcgcgccatcagagagtgtcgcatctgacttgcctggcccagtacacctggctccccgctatccccagacagcagactcacctgaggagacggtgaccagggtgccctggccccagtgctggaagtatgtcgacagagtgtcgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaagagtgtcgcatctgactgagcgggctggcaaggc

SEQ ID NO: 1880 - DNA, 495 bp, Artificial Sequence
  source: /note="Description of Artificial Sequence: Synthetic polynucleotide"
gcctccctcgcgccatcagagagtgtctgctacaccttgcctggcccagtacacctggctccccgctatccccagacagcagactcacctgaggagacggtgaccagggtgccctggccccagtgctggaagtatgtcgacagagtgtctgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgagagtgtctgctacacctgagcgggctggcaaggc

SEQ ID NO: 1881 - DNA, 495 bp, Artificial Sequence
  source: /note="Description of Artificial Sequence: Synthetic polynucleotide"
gcctccctcgcgccatcagagagtgtcaactgccacttgcctggcccagtacacctggctccccgctatccccagacagcagactcacctgaggagacggtgaccagggtgccctggccccagtgctggaagtatgtcgacagagtgtcaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttagagtgtcaactgccactgagcgggctggcaaggc

SEQ ID NO: 1882 - DNA, 495 bp, Artificial Sequence
  source: /note="Description of Artificial Sequence: Synthetic polynucleotide"
gcctccctcgcgccatcagagagtgtcttggactgcttgcctggcccagtacacctggctccccgctatccccagacagcagactcacctgaggagacggtgaccagggtgccctggccccagtgctggaagtatgtcgacagagtgtcttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggagagtgtcttggactgctgagcgggctggcaaggc

SEQ ID NO: 1883 - DNA, 495 bp, Artificial Sequence
  source: /note="Description of Artificial Sequence: Synthetic polynucleotide"
gcctccctcgcgccatcagagagtgtctcggtactcttgcctggcccagtacacctggctccccgctatccccagacagcagactcacctgaggagacggtgaccagggtgccctggccccagtgctggaagtatgtcgacagagtgtctcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgagagtgtctcggtactctgagcgggctggcaaggc

SEQ ID NO: 1884 - DNA, 495 bp, Artificial Sequence
  source: /note="Description of Artificial Sequence: Synthetic polynucleotide"
gcctccctcgcgccatcagagagtgtcccatggatcttgcctggcccagtacacctggctccccgctatccccagacagcagactcacctgaggagacggtgaccagggtgccctggccccagtgctggaagtatgtcgacagagtgtcccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacagagtgtcccatggatctgagcgggctggcaaggc

SEQ ID NO: 1885 - DNA, 495 bp, Artificial Sequence
  source: /note="Description of Artificial Sequence: Synthetic polynucleotide"
gcctccctcgcgccatcagagagtgtcacgaagatcttgcctggcccagtacacctggctccccgctatccccagacagcagactcacctgaggagacggtgaccagggtgccctggccccagtgctggaagtatgtcgacagagtgtcacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaagagtgtcacgaagatctgagcgggctggcaaggc

SEQ ID NO: 1886 - DNA, 495 bp, Artificial Sequence
  source: /note="Description of Artificial Sequence: Synthetic polynucleotide"
gcctccctcgcgccatcagagagtgtcactgtggacttgcctggcccagtacacctggctccccgctatccccagacagcagactcacctgaggagacggtgaccagggtgccctggccccagtgctggaagtatgtcgacagagtgtcactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttagagtgtcactgtggactgagcgggctggcaaggc

SEQ ID NO: 1887 - DNA, 495 bp, Artificial Sequence
  source: /note="Description of Artificial Sequence: Synthetic polynucleotide"
gcctccctcgcgccatcagagagtgtcggtgtcatcttgcctggcccagtacacctggctccccgctatccccagacagcagactcacctgaggagacggtgaccagggtgccctggccccagtgctggaagtatgtcgacagagtgtcggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctagagtgtcggtgtcatctgagcgggctggcaaggc

SEQ ID NO: 1888 - DNA, 495 bp, Artificial Sequence
  source: /note="Description of Artificial Sequence: Synthetic polynucleotide"
gcctccctcgcgccatcagagagtgtctcgtgaagcttgcctggcccagtacacctggctccccgctatccccagacagcagactcacctgaggagacggtgaccagggtgccctggccccagtgctggaagtatgtcgacagagtgtctcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggagagtgtctcgtgaagctgagcgggctggcaaggc

SEQ ID NO: 1889 - DNA, 495 bp, Artificial Sequence
  source: /note="Description of Artificial Sequence: Synthetic polynucleotide"
gcctccctcgcgccatcagagagtgtccactagctcttgcctggcccagtacacctggctccccgctatccccagacagcagactcacctgaggagacggtgaccagggtgccctggccccagtgctggaagtatgtcgacagagtgtccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaagagtgtccactagctctgagcgggctggcaaggc

SEQ ID NO: 1890 - DNA, 495 bp, Artificial Sequence
  source: /note="Description of Artificial Sequence: Synthetic polynucleotide"
gcctccctcgcgccatcagagagtgtcggtcaactcttgcctggcccagtacacctggctccccgctatccccagacagcagactcacctgaggagacggtgaccagggtgccctggccccagtgctggaagtatgtcgacagagtgtcggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaagagtgtcggtcaactctgagcgggctggcaaggc

SEQ ID NO: 1891 - DNA, 495 bp, Artificial Sequence
  source: /note="Description of Artificial Sequence: Synthetic polynucleotide"
gcctccctcgcgccatcagagagtgtctacgtacgcttgcctggcccagtacacctggctccccgctatccccagacagcagactcacctgaggagacggtgaccagggtgccctggccccagtgctggaagtatgtcgacagagtgtctacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcagagtgtctacgtacgctgagcgggctggcaaggc

SEQ ID NO: 1892 - DNA, 495 bp, Artificial Sequence
  source: /note="Description of Artificial Sequence: Synthetic polynucleotide"
gcctccctcgcgccatcagagagtgtcatgacacccttgcctggcccagtacacctggctccccgctatccccagacagcagactcacctgaggagacggtgaccagggtgccctggccccagtgctggaagtatgtcgacagagtgtcatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggagagtgtcatgacaccctgagcgggctggcaaggc

SEQ ID NO: 1893 - DNA, 495 bp, Artificial Sequence
  source: /note="Description of Artificial Sequence: Synthetic polynucleotide"
gcctccctcgcgccatcagagagtgtccttcacgacttgcctggcccagtacacctggctccccgctatccccagacagcagactcacctgaggagacggtgaccagggtgccctggccccagtgctggaagtatgtcgacagagtgtccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacagagtgtccttcacgactgagcgggctggcaaggc

SEQ ID NO: 1894 - DNA, 495 bp, Artificial Sequence
  source: /note="Description of Artificial Sequence: Synthetic polynucleotide"
gcctccctcgcgccatcagagagtgtcagaatcagcttgcctggcccagtacacctggctccccgctatccccagacagcagactcacctgaggagacggtgaccagggtgccctggccccagtgctggaagtatgtcgacagagtgtcagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccagagtgtcagaatcagctgagcgggctggcaaggc

SEQ ID NO: 1895 - DNA, 495 bp, Artificial Sequence
  source: /note="Description of Artificial Sequence: Synthetic polynucleotide"
gcctccctcgcgccatcagagagtgtcagttatgccttgcctggcccagtacacctggctccccgctatccccagacagcagactcacctgaggagacggtgaccagggtgccctggccccagtgctggaagtatgtcgacagagtgtcagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaagagtgtcagttatgcctgagcgggctggcaaggc

SEQ ID NO: 1896 - DNA, 495 bp, Artificial Sequence
  source: /note="Description of Artificial Sequence: Synthetic polynucleotide"
gcctccctcgcgccatcagagagtgtcaggtctcacttgcctggcccagtacacctggctccccgctatccccagacagcagactcacctgaggagacggtgaccagggtgccctggccccagtgctggaagtatgtcgacagagtgtcaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccagagtgtcaggtctcactgagcgggctggcaaggc

SEQ ID NO: 1897 - DNA, 495 bp, Artificial Sequence
  source: /note="Description of Artificial Sequence: Synthetic polynucleotide"
gcctccctcgcgccatcagagagtgtcgtcatagtcttgcctggcccagtacacctggctccccgctatccccagacagcagactcacctgaggagacggtgaccagggtgccctggccccagtgctggaagtatgtcgacagagtgtcgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtagagtgtcgtcatagtctgagcgggctggcaaggc

SEQ ID NO: 1898 - DNA, 495 bp, Artificial Sequence
  source: /note="Description of Artificial Sequence: Synthetic polynucleotide"
gcctccctcgcgccatcagagagtgtcgtgacttgcttgcctggcccagtacacctggctccccgctatccccagacagcagactcacctgaggagacggtgaccagggtgccctggccccagtgctggaagtatgtcgacagagtgtcgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgagagtgtcgtgacttgctgagcgggctggcaaggc

SEQ ID NO: 1899 - DNA, 495 bp, Artificial Sequence
  source: /note="Description of Artificial Sequence: Synthetic polynucleotide"
gcctccctcgcgccatcagagagtgtcgattgcagcttgcctggcccagtacacctggctccccgctatccccagacagcagactcacctgaggagacggtgaccagggtgccctggccccagtgctggaagtatgtcgacagagtgtcgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccagagtgtcgattgcagctgagcgggctggcaaggc

SEQ ID NO: 1900 - DNA, 495 bp, Artificial Sequence
  source: /note="Description of Artificial Sequence: Synthetic polynucleotide"
gcctccctcgcgccatcagagagtgtcactatgaccttgcctggcccagtacacctggctccccgctatccccagacagcagactcacctgaggagacggtgaccagggtgccctggccccagtgctggaagtatgtcgacagagtgtcactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacagagtgtcactatgacctgagcgggctggcaaggc

SEQ ID NO: 1901 - DNA, 495 bp, Artificial Sequence
  source: /note="Description of Artificial Sequence: Synthetic polynucleotide"
gcctccctcgcgccatcagagagtgtcatggtcaacttgcctggcccagtacacctggctccccgctatccccagacagcagactcacctgaggagacggtgaccagggtgccctggccccagtgctggaagtatgtcgacagagtgtcatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacagagtgtcatggtcaactgagcgggctggcaaggc

SEQ ID NO: 1902 - DNA, 495 bp, Artificial Sequence
  source: /note="Description of Artificial Sequence: Synthetic polynucleotide"
gcctccctcgcgccatcagagagtgtcgatggcttcttgcctggcccagtacacctggctccccgctatccccagacagcagactcacctgaggagacggtgaccagggtgccctggccccagtgctggaagtatgtcgacagagtgtcgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacagagtgtcgatggcttctgagcgggctggcaaggc

SEQ ID NO: 1903 - DNA, 495 bp, Artificial Sequence
  source: /note="Description of Artificial Sequence: Synthetic polynucleotide"
gcctccctcgcgccatcagagagtgtcagcatatgcttgcctggcccagtacacctggctccccgctatccccagacagcagactcacctgaggagacggtgaccagggtgccctggccccagtgctggaagtatgtcgacagagtgtcagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacagagtgtcagcatatgctgagcgggctggcaaggc

SEQ ID NO: 1904 - DNA, 495 bp, Artificial Sequence
  source: /note="Description of Artificial Sequence: Synthetic polynucleotide"
gcctccctcgcgccatcagagagtgtccatatgctcttgcctggcccagtacacctggctccccgctatccccagacagcagactcacctgaggagacggtgaccagggtgccctggccccagtgctggaagtatgtcgacagagtgtccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgagagtgtccatatgctctgagcgggctggcaaggc

SEQ ID NO: 1905 - DNA, 495 bp, Artificial Sequence
  source: /note="Description of Artificial Sequence: Synthetic polynucleotide"
gcctccctcgcgccatcagagagtgtctcgtcgatcttgcctggcccagtacacctggctccccgctatccccagacagcagactcacctgaggagacggtgaccagggtgccctggccccagtgctggaagtatgtcgacagagtgtctcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccagagtgtctcgtcgatctgagcgggctggcaaggc

SEQ ID NO: 1906 - DNA, 495 bp, Artificial Sequence
  source: /note="Description of Artificial Sequence: Synthetic polynucleotide"
gcctccctcgcgccatcagagagtgtccagtctgtcttgcctggcccagtacacctggctccccgctatccccagacagcagactcacctgaggagacggtgaccagggtgccctggccccagtgctggaagtatgtcgacagagtgtccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcagagtgtccagtctgtctgagcgggctggcaaggc

SEQ ID NO: 1907 - DNA, 495 bp, Artificial Sequence
  source: /note="Description of Artificial Sequence: Synthetic polynucleotide"
gcctccctcgcgccatcagagagtgtcaacgcgtacttgcctggcccagtacacctggctccccgctatccccagacagcagactcacctgaggagacggtgaccagggtgccctggccccagtgctggaagtatgtcgacagagtgtcaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgagagtgtcaacgcgtactgagcgggctggcaaggc

SEQ ID NO: 1908 - DNA, 495 bp, Artificial Sequence
  source: /note="Description of Artificial Sequence: Synthetic polynucleotide"
gcctccctcgcgccatcagagagtgtcgtagttcgcttgcctggcccagtacacctggctccccgctatccccagacagcagactcacctgaggagacggtgaccagggtgccctggccccagtgctggaagtatgtcgacagagtgtcgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcagagtgtcgtagttcgctgagcgggctggcaaggc

SEQ ID NO: 1909 - DNA, 495 bp, Artificial Sequence
  source: /note="Description of Artificial Sequence: Synthetic polynucleotide"
gcctccctcgcgccatcagagagtgtccgaactaccttgcctggcccagtacacctggctccccgctatccccagacagcagactcacctgaggagacggtgaccagggtgccctggccccagtgctggaagtatgtcgacagagtgtccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacagagtgtccgaactacctgagcgggctggcaaggc

SEQ ID NO: 1910 - DNA, 495 bp, Artificial Sequence
  source: /note="Description of Artificial Sequence: Synthetic polynucleotide"
gcctccctcgcgccatcagagagtgtcttaacgtccttgcctggcccagtacacctggctccccgctatccccagacagcagactcacctgaggagacggtgaccagggtgccctggccccagtgctggaagtatgtcgacagagtgtcttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccagagtgtcttaacgtcctgagcgggctggcaaggc

SEQ ID NO: 1911 - DNA, 495 bp, Artificial Sequence
  source: /note="Description of Artificial Sequence: Synthetic polynucleotide"
gcctccctcgcgccatcagagagtgtcagcaacctcttgcctggcccagtacacctggctccccgctatccccagacagcagactcacctgaggagacggtgaccagggtgccctggccccagtgctggaagtatgtcgacagagtgtcagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacagagtgtcagcaacctctgagcgggctggcaaggc

SEQ ID NO: 1912 - DNA, 495 bp, Artificial Sequence
  source: /note="Description of Artificial Sequence: Synthetic polynucleotide"
gcctccctcgcgccatcagagagtgtcttctcgagcttgcctggcccagtacacctggctccccgctatccccagacagcagactcacctgaggagacggtgaccagggtgccctggccccagtgctggaagtatgtcgacagagtgtcttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttagagtgtcttctcgagctgagcgggctggcaaggc

SEQ ID NO: 1913 - DNA, 495 bp, Artificial Sequence
  source: /note="Description of Artificial Sequence: Synthetic polynucleotide"
gcctccctcgcgccatcagagagtgtcactctacgcttgcctggcccagtacacctggctccccgctatccccagacagcagactcacctgaggagacggtgaccagggtgccctggccccagtgctggaagtatgtcgacagagtgtcactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacagagtgtcactctacgctgagcgggctggcaaggc

SEQ ID NO: 1914 - DNA, 495 bp, Artificial Sequence
  source: /note="Description of Artificial Sequence: Synthetic polynucleotide"
gcctccctcgcgccatcagagagtgtctaccggaacttgcctggcccagtacacctggctccccgctatccccagacagcagactcacctgaggagacggtgaccagggtgccctggccccagtgctggaagtatgtcgacagagtgtctaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccagagtgtctaccggaactgagcgggctggcaaggc

SEQ ID NO: 1915 - DNA, 495 bp, Artificial Sequence
  source: /note="Description of Artificial Sequence: Synthetic polynucleotide"
gcctccctcgcgccatcagagagtgtccgaattgccttgcctggcccagtacacctggctccccgctatccccagacagcagactcacctgaggagacggtgaccagggtgccctggccccagtgctggaagtatgtcgacagagtgtccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacagagtgtccgaattgcctgagcgggctggcaaggc

SEQ ID NO: 1916 - DNA, 495 bp, Artificial Sequence
  source: /note="Description of Artificial Sequence: Synthetic polynucleotide"
gcctccctcgcgccatcagagagtgtcttcgctcacttgcctggcccagtacacctggctccccgctatccccagacagcagactcacctgaggagacggtgaccagggtgccctggccccagtgctggaagtatgtcgacagagtgtcttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaagagtgtcttcgctcactgagcgggctggcaaggc

SEQ ID NO: 1917 - DNA, 495 bp, Artificial Sequence
  source: /note="Description of Artificial Sequence: Synthetic polynucleotide"
gcctccctcgcgccatcagagagtgtcgacgttaacttgcctggcccagtacacctggctccccgctatccccagacagcagactcacctgaggagacggtgaccagggtgccctggccccagtgctggaagtatgtcgacagagtgtcgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgagagtgtcgacgttaactgagcgggctggcaaggc

SEQ ID NO: 1918 - DNA, 495 bp, Artificial Sequence
  source: /note="Description of Artificial Sequence: Synthetic polynucleotide"
gcctccctcgcgccatcagagagtgtccgtagagtcttgcctggcccagtacacctggctccccgctatccccagacagcagactcacctgaggagacggtgaccagggtgccctggccccagtgctggaagtatgtcgacagagtgtccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcagagtgtccgtagagtctgagcgggctggcaaggc

SEQ ID NO: 1919 - DNA, 495 bp, Artificial Sequence
  source: /note="Description of Artificial Sequence: Synthetic polynucleotide"
gcctccctcgcgccatcagagagtgtcttccggtacttgcctggcccagtacacctggctccccgctatccccagacagcagactcacctgaggagacggtgaccagggtgccctggccccagtgctggaagtatgtcgacagagtgtcttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcagagtgtcttccggtactgagcgggctggcaaggc

SEQ ID NO: 1920 - DNA, 495 bp, Artificial Sequence
  source: /note="Description of Artificial Sequence: Synthetic polynucleotide"
gcctccctcgcgccatcagagagtgtcgcaattcgcttgcctggcccagtacacctggctccccgctatccccagacagcagactcacctgaggagacggtgaccagggtgccctggccccagtgctggaagtatgtcgacagagtgtcgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacagagtgtcgcaattcgctgagcgggctggcaaggc

SEQ ID NO: 1921 - DNA, 495 bp, Artificial Sequence
  source: /note="Description of Artificial Sequence: Synthetic polynucleotide"
gcctccctcgcgccatcagagagtgtctgagcgaacttgcctggcccagtacacctggctccccgctatccccagacagcagactcacctgaggagacggtgaccagggtgccctggccccagtgctggaagtatgtcgacagagtgtctgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcagagtgtctgagcgaactgagcgggctggcaaggc

SEQ ID NO: 1922 - DNA, 495 bp, Artificial Sequence
  source: /note="Description of Artificial Sequence: Synthetic polynucleotide"
gcctccctcgcgccatcagagagtgtctactaagccttgcctggcccagtacacctggctccccgctatccccagacagcagactcacctgaggagacggtgaccagggtgccctggccccagtgctggaagtatgtcgacagagtgtctactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccagagtgtctactaagcctgagcgggctggcaaggc

SEQ ID NO: 1923 - DNA, 495 bp, Artificial Sequence
  source: /note="Description of Artificial Sequence: Synthetic polynucleotide"
gcctccctcgcgccatcagagagtgtctggcgtatcttgcctggcccagtacacctggctccccgctatccccagacagcagactcacctgaggagacggtgaccagggtgccctggccccagtgctggaagtatgtcgacagagtgtctggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtagagtgtctggcgtatctgagcgggctggcaaggc

SEQ ID NO: 1924 - DNA, 495 bp, Artificial Sequence
  source: /note="Description of Artificial Sequence: Synthetic polynucleotide"
gcctccctcgcgccatcagagagtgtcgataaccacttgcctggcccagtacacctggctccccgctatccccagacagcagactcacctgaggagacggtgaccagggtgccctggccccagtgctggaagtatgtcgacagagtgtcgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgagagtgtcgataaccactgagcgggctggcaaggc

SEQ ID NO: 1925 - DNA, 495 bp, Artificial Sequence
  source: /note="Description of Artificial Sequence: Synthetic polynucleotide"
gcctccctcgcgccatcagagagtgtcctagtgaacttgcctggcccagtacacctggctccccgctatccccagacagcagactcacctgaggagacggtgaccagggtgccctggccccagtgctggaagtatgtcgacagagtgtcctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagagagtgtcctagtgaactgagcgggctggcaaggc

SEQ ID NO: 1926 - DNA, 495 bp, Artificial Sequence
  source: /note="Description of Artificial Sequence: Synthetic polynucleotide"
gcctccctcgcgccatcagagagtgtcacgttcaccttgcctggcccagtacacctggctccccgctatccccagacagcagactcacctgaggagacggtgaccagggtgccctggccccagtgctggaagtatgtcgacagagtgtcacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtagagtgtcacgttcacctgagcgggctggcaaggc

SEQ ID NO: 1927 - DNA, 448 bp, Artificial Sequence
  source: /note="Description of Artificial Sequence: Synthetic polynucleotide"
gcctccctcgcgccatcagagagtgtcattacgctcttgcctggcccagtacacctggctccccgctatccccagacagcagactcacctgaggagacggtgaccagggtgccctggccccagtgctggaagtatgtcgacagagtgtcattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaagagtgtcattacgctctgagcgggctggcaaggc

SEQ ID NO: 1928 - DNA, 495 bp, Artificial Sequence
  source: /note="Description of Artificial Sequence: Synthetic polynucleotide"
gcctccctcgcgccatcagagagtgtccattgagtcttgcctggcccagtacacctggctccccgctatccccagacagcagactcacctgaggagacggtgaccagggtgccctggccccagtgctggaagtatgtcgacagagtgtccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccagagtgtccattgagtctgagcgggctggcaaggc

SEQ ID NO: 1929 - DNA, 495 bp, Artificial Sequence
  source: /note="Description of Artificial Sequence: Synthetic polynucleotide"
gcctccctcgcgccatcaggttccgaacttggttatggcctggtgcctggacagagaagactgggagggggctgcagtgggactcacctgaggagacagtgaccagggtgccacggccccagagatcgaagtaccgtcgacgttccgaacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgttccgaacttggttactgagcgggctggcaaggc

SEQ ID NO: 1930 - DNA, 495 bp, Artificial Sequence
  source: /note="Description of Artificial Sequence: Synthetic polynucleotide"
gcctccctcgcgccatcaggttccgaaacctcttgtggcctggtgcctggacagagaagactgggagggggctgcagtgggactcacctgaggagacagtgaccagggtgccacggccccagagatcgaagtaccgtcgacgttccgaaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgttccgaaacctcttgctgagcgggctggcaaggc

SEQ ID NO: 1931 - DNA, 495 bp, Artificial Sequence
  source: /note="Description of Artificial Sequence: Synthetic polynucleotide"
gcctccctcgcgccatcaggttccgaactgattcttggcctggtgcctggacagagaagactgggagggggctgcagtgggactcacctgaggagacagtgaccagggtgccacggccccagagatcgaagtaccgtcgacgttccgaactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgttccgaactgattctctgagcgggctggcaaggc

SEQ ID NO: 1932 - DNA, 495 bp, Artificial Sequence
  source: /note="Description of Artificial Sequence: Synthetic polynucleotide"
gcctccctcgcgccatcaggttccgaaagtaccgatggcctggtgcctggacagagaagactgggagggggctgcagtgggactcacctgaggagacagtgaccagggtgccacggccccagagatcgaagtaccgtcgacgttccgaaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgttccgaaagtaccgactgagcgggctggcaaggc

SEQ ID NO: 1933 - DNA, 495 bp, Artificial Sequence
  source: /note="Description of Artificial Sequence: Synthetic polynucleotide"
gcctccctcgcgccatcaggttccgaaatccatggtggcctggtgcctggacagagaagactgggagggggctgcagtgggactcacctgaggagacagtgaccagggtgccacggccccagagatcgaagtaccgtcgacgttccgaaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgttccgaaatccatggctgagcgggctggcaaggc

SEQ ID NO: 1934 - DNA, 495 bp, Artificial Sequence
  source: /note="Description of Artificial Sequence: Synthetic polynucleotide"
gcctccctcgcgccatcaggttccgaagtagcagttggcctggtgcctggacagagaagactgggagggggctgcagtgggactcacctgaggagacagtgaccagggtgccacggccccagagatcgaagtaccgtcgacgttccgaagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgttccgaagtagcagtctgagcgggctggcaaggc

SEQ ID NO: 1935 - DNA, 495 bp, Artificial Sequence
  source: /note="Description of Artificial Sequence: Synthetic polynucleotide"
gcctccctcgcgccatcaggttccgaaatcttcgttggcctggtgcctggacagagaagactgggagggggctgcagtgggactcacctgaggagacagtgaccagggtgccacggccccagagatcgaagtaccgtcgacgttccgaaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgttccgaaatcttcgtctgagcgggctggcaaggc

SEQ ID NO: 1936 - DNA, 495 bp, Artificial Sequence
  source: /note="Description of Artificial Sequence: Synthetic polynucleotide"
gcctccctcgcgccatcaggttccgaatccacagttggcctggtgcctggacagagaagactgggagggggctgcagtgggactcacctgaggagacagtgaccagggtgccacggccccagagatcgaagtaccgtcgacgttccgaatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgttccgaatccacagtctgagcgggctggcaaggc

SEQ ID NO: 1937 - DNA, 495 bp, Artificial Sequence
  source: /note="Description of Artificial Sequence: Synthetic polynucleotide"
gcctccctcgcgccatcaggttccgaaagctagtgtggcctggtgcctggacagagaagactgggagggggctgcagtgggactcacctgaggagacagtgaccagggtgccacggccccagagatcgaagtaccgtcgacgttccgaaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgttccgaaagctagtgctgagcgggctggcaaggc

SEQ ID NO: 1938 - DNA, 495 bp, Artificial Sequence
  source: /note="Description of Artificial Sequence: Synthetic polynucleotide"
gcctccctcgcgccatcaggttccgaataaccaagtggcctggtgcctggacagagaagactgggagggggctgcagtgggactcacctgaggagacagtgaccagggtgccacggccccagagatcgaagtaccgtcgacgttccgaataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgttccgaataaccaagctgagcgggctggcaaggc

SEQ ID NO: 1939 - DNA, 495 bp, Artificial Sequence
  source: /note="Description of Artificial Sequence: Synthetic polynucleotide"
gcctccctcgcgccatcaggttccgaacaagaggttggcctggtgcctggacagagaagactgggagggggctgcagtgggactcacctgaggagacagtgaccagggtgccacggccccagagatcgaagtaccgtcgacgttccgaacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgttccgaacaagaggtctgagcgggctggcaaggc

SEQ ID NO: 1940 - DNA, 495 bp, Artificial Sequence
  source: /note="Description of Artificial Sequence: Synthetic polynucleotide"
gcctccctcgcgccatcaggttccgaaagttgacctggcctggtgcctggacagagaagactgggagggggctgcagtgggactcacctgaggagacagtgaccagggtgccacggccccagagatcgaagtaccgtcgacgttccgaaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagttccgaaagttgaccctgagcgggctggcaaggc

SEQ ID NO: 1941 - DNA, 495 bp, Artificial Sequence
  source: /note="Description of Artificial Sequence: Synthetic polynucleotide"
gcctccctcgcgccatcaggttccgaacagcatattggcctggtgcctggacagagaagactgggagggggctgcagtgggactcacctgaggagacagtgaccagggtgccacggccccagagatcgaagtaccgtcgacgttccgaacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagttccgaacagcatatctgagcgggctggcaaggc

SEQ ID NO: 1942 - DNA, 495 bp, Artificial Sequence
  source: /note="Description of Artificial Sequence: Synthetic polynucleotide"
gcctccctcgcgccatcaggttccgaagcaggatttggcctggtgcctggacagagaagactgggagggggctgcagtgggactcacctgaggagacagtgaccagggtgccacggccccagagatcgaagtaccgtcgacgttccgaagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagttccgaagcaggattctgagcgggctggcaaggc

SEQ ID NO: 1943 - DNA, 495 bp, Artificial Sequence
  source: /note="Description of Artificial Sequence: Synthetic polynucleotide"
gcctccctcgcgccatcaggttccgaagtccattctggcctggtgcctggacagagaagactgggagggggctgcagtgggactcacctgaggagacagtgaccagggtgccacggccccagagatcgaagtaccgtcgacgttccgaagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgttccgaagtccattcctgagcgggctggcaaggc

SEQ ID NO: 1944 - DNA, 495 bp, Artificial Sequence
  source: /note="Description of Artificial Sequence: Synthetic polynucleotide"
gcctccctcgcgccatcaggttccgaagcataacttggcctggtgcctggacagagaagactgggagggggctgcagtgggactcacctgaggagacagtgaccagggtgccacggccccagagatcgaagtaccgtcgacgttccgaagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgttccgaagcataactctgagcgggctggcaaggc

SEQ ID NO: 1945 - DNA, 495 bp, Artificial Sequence
  source: /note="Description of Artificial Sequence: Synthetic polynucleotide"
gcctccctcgcgccatcaggttccgaaatatgctgtggcctggtgcctggacagagaagactgggagggggctgcagtgggactcacctgaggagacagtgaccagggtgccacggccccagagatcgaagtaccgtcgacgttccgaaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgttccgaaatatgctgctgagcgggctggcaaggc

SEQ ID NO: 1946 - DNA, 495 bp, Artificial Sequence
  source: /note="Description of Artificial Sequence: Synthetic polynucleotide"
gcctccctcgcgccatcaggttccgaaaatcctgctggcctggtgcctggacagagaagactgggagggggctgcagtgggactcacctgaggagacagtgaccagggtgccacggccccagagatcgaagtaccgtcgacgttccgaaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgttccgaaaatcctgcctgagcgggctggcaaggc

SEQ ID NO: 1947 - DNA, 495 bp, Artificial Sequence
  source: /note="Description of Artificial Sequence: Synthetic polynucleotide"
gcctccctcgcgccatcaggttccgaatgagaccttggcctggtgcctggacagagaagactgggagggggctgcagtgggactcacctgaggagacagtgaccagggtgccacggccccagagatcgaagtaccgtcgacgttccgaatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggttccgaatgagacctctgagcgggctggcaaggc

SEQ ID NO: 1948 - DNA, 495 bp, Artificial Sequence
  source: /note="Description of Artificial Sequence: Synthetic polynucleotide"
gcctccctcgcgccatcaggttccgaagaatggactggcctggtgcctggacagagaagactgggagggggctgcagtgggactcacctgaggagacagtgaccagggtgccacggccccagagatcgaagtaccgtcgacgttccgaagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgttccgaagaatggacctgagcgggctggcaaggc

SEQ ID NO: 1949 - DNA, 495 bp, Artificial Sequence
  source: /note="Description of Artificial Sequence: Synthetic polynucleotide"
gcctccctcgcgccatcaggttccgaacacatggatggcctggtgcctggacagagaagactgggagggggctgcagtgggactcacctgaggagacagtgaccagggtgccacggccccagagatcgaagtaccgtcgacgttccgaacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgttccgaacacatggactgagcgggctggcaaggc

SEQ ID NO: 1950 - DNA, 495 bp, Artificial Sequence
  source: /note="Description of Artificial Sequence: Synthetic polynucleotide"
gcctccctcgcgccatcaggttccgaattgaccattggcctggtgcctggacagagaagactgggagggggctgcagtgggactcacctgaggagacagtgaccagggtgccacggccccagagatcgaagtaccgtcgacgttccgaattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgttccgaattgaccatctgagcgggctggcaaggc

SEQ ID NO: 1951 - DNA, 495 bp, Artificial Sequence
  source: /note="Description of Artificial Sequence: Synthetic polynucleotide"
gcctccctcgcgccatcaggttccgaaaagccatctggcctggtgcctggacagagaagactgggagggggctgcagtgggactcacctgaggagacagtgaccagggtgccacggccccagagatcgaagtaccgtcgacgttccgaaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgttccgaaaagccatcctgagcgggctggcaaggc

SEQ ID NO: 1952 - DNA, 495 bp, Artificial Sequence
  source: /note="Description of Artificial Sequence: Synthetic polynucleotide"
gcctccctcgcgccatcaggttccgaatccatgtgtggcctggtgcctggacagagaagactgggagggggctgcagtgggactcacctgaggagacagtgaccagggtgccacggccccagagatcgaagtaccgtcgacgttccgaatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaatccatgtgctgagcgggctggcaaggc

SEQ ID NO: 1953 - DNA, 495 bp, Artificial Sequence
  source: /note="Description of Artificial Sequence: Synthetic polynucleotide"
gcctccctcgcgccatcaggttccgaacaagtcactggcctggtgcctggacagagaagactgggagggggctgcagtgggactcacctgaggagacagtgaccagggtgccacggccccagagatcgaagtaccgtcgacgttccgaacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaacaagtcacctgagcgggctggcaaggc

SEQ ID NO: 1954 - DNA, 495 bp, Artificial Sequence
  source: /note="Description of Artificial Sequence: Synthetic polynucleotide"
gcctccctcgcgccatcaggttccgaactgcaatctggcctggtgcctggacagagaagactgggagggggctgcagtgggactcacctgaggagacagtgaccagggtgccacggccccagagatcgaagtaccgtcgacgttccgaactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgttccgaactgcaatcctgagcgggctggcaaggc

SEQ ID NO: 1955 - DNA, 495 bp, Artificial Sequence
  source: /note="Description of Artificial Sequence: Synthetic polynucleotide"
gcctccctcgcgccatcaggttccgaaatcgacgatggcctggtgcctggacagagaagactgggagggggctgcagtgggactcacctgaggagacagtgaccagggtgccacggccccagagatcgaagtaccgtcgacgttccgaaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgttccgaaatcgacgactgagcgggctggcaaggc

SEQ ID NO: 1956 - DNA, 495 bp, Artificial Sequence
  source: /note="Description of Artificial Sequence: Synthetic polynucleotide"
gcctccctcgcgccatcaggttccgaaacagactgtggcctggtgcctggacagagaagactgggagggggctgcagtgggactcacctgaggagacagtgaccagggtgccacggccccagagatcgaagtaccgtcgacgttccgaaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagttccgaaacagactgctgagcgggctggcaaggc

SEQ ID NO: 1957 - DNA, 495 bp, Artificial Sequence
  source: /note="Description of Artificial Sequence: Synthetic polynucleotide"
gcctccctcgcgccatcaggttccgaaccttatagtggcctggtgcctggacagagaagactgggagggggctgcagtgggactcacctgaggagacagtgaccagggtgccacggccccagagatcgaagtaccgtcgacgttccgaaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgttccgaaccttatagctgagcgggctggcaaggc

SEQ ID NO: 1958 - DNA, 495 bp, Artificial Sequence
  source: /note="Description of Artificial Sequence: Synthetic polynucleotide"
gcctccctcgcgccatcaggttccgaatacgcgtttggcctggtgcctggacagagaagactgggagggggctgcagtgggactcacctgaggagacagtgaccagggtgccacggccccagagatcgaagtaccgtcgacgttccgaatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgttccgaatacgcgttctgagcgggctggcaaggc

SEQ ID NO: 1959 - DNA, 495 bp, Artificial Sequence
  source: /note="Description of Artificial Sequence: Synthetic polynucleotide"
gcctccctcgcgccatcaggttccgaactataaggtggcctggtgcctggacagagaagactgggagggggctgcagtgggactcacctgaggagacagtgaccagggtgccacggccccagagatcgaagtaccgtcgacgttccgaactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggttccgaactataaggctgagcgggctggcaaggc

SEQ ID NO: 1960 - DNA, 495 bp, Artificial Sequence
  source: /note="Description of Artificial Sequence: Synthetic polynucleotide"
gcctccctcgcgccatcaggttccgaatcttagtctggcctggtgcctggacagagaagactgggagggggctgcagtgggactcacctgaggagacagtgaccagggtgccacggccccagagatcgaagtaccgtcgacgttccgaatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaatcttagtcctgagcgggctggcaaggc

SEQ ID NO: 1961 - DNA, 495 bp, Artificial Sequence
  source: /note="Description of Artificial Sequence: Synthetic polynucleotide"
gcctccctcgcgccatcaggttccgaatgtctgcatggcctggtgcctggacagagaagactgggagggggctgcagtgggactcacctgaggagacagtgaccagggtgccacggccccagagatcgaagtaccgtcgacgttccgaatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgttccgaatgtctgcactgagcgggctggcaaggc

SEQ ID NO: 1962 - DNA, 495 bp, Artificial Sequence
  source: /note="Description of Artificial Sequence: Synthetic polynucleotide"
gcctccctcgcgccatcaggttccgaagccattaatggcctggtgcctggacagagaagactgggagggggctgcagtgggactcacctgaggagacagtgaccagggtgccacggccccagagatcgaagtaccgtcgacgttccgaagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaagccattaactgagcgggctggcaaggc

SEQ ID NO: 1963 - DNA, 495 bp, Artificial Sequence
  source: /note="Description of Artificial Sequence: Synthetic polynucleotide"
gcctccctcgcgccatcaggttccgaagactaagatggcctggtgcctggacagagaagactgggagggggctgcagtgggactcacctgaggagacagtgaccagggtgccacggccccagagatcgaagtaccgtcgacgttccgaagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggttccgaagactaagactgagcgggctggcaaggc

SEQ ID NO: 1964 - DNA, 495 bp, Artificial Sequence
  source: /note="Description of Artificial Sequence: Synthetic polynucleotide"
gcctccctcgcgccatcaggttccgaaaggttgcttggcctggtgcctggacagagaagactgggagggggctgcagtgggactcacctgaggagacagtgaccagggtgccacggccccagagatcgaagtaccgtcgacgttccgaaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggttccgaaaggttgctctgagcgggctggcaaggc

SEQ ID NO: 1965 - DNA, 495 bp, Artificial Sequence
  source: /note="Description of Artificial Sequence: Synthetic polynucleotide"
gcctccctcgcgccatcaggttccgaactcgagaatggcctggtgcctggacagagaagactgggagggggctgcagtgggactcacctgaggagacagtgaccagggtgccacggccccagagatcgaagtaccgtcgacgttccgaactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgttccgaactcgagaactgagcgggctggcaaggc

SEQ ID NO: 1966 - DNA, 495 bp, Artificial Sequence
  source: /note="Description of Artificial Sequence: Synthetic polynucleotide"
gcctccctcgcgccatcaggttccgaattaatggctggcctggtgcctggacagagaagactgggagggggctgcagtgggactcacctgaggagacagtgaccagggtgccacggccccagagatcgaagtaccgtcgacgttccgaattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgttccgaattaatggcctgagcgggctggcaaggc

SEQ ID NO: 1967 - DNA, 495 bp, Artificial Sequence
  source: /note="Description of Artificial Sequence: Synthetic polynucleotide"
gcctccctcgcgccatcaggttccgaatgcagacatggcctggtgcctggacagagaagactgggagggggctgcagtgggactcacctgaggagacagtgaccagggtgccacggccccagagatcgaagtaccgtcgacgttccgaatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagttccgaatgcagacactgagcgggctggcaaggc

SEQ ID NO: 1968 - DNA, 495 bp, Artificial Sequence
  source: /note="Description of Artificial Sequence: Synthetic polynucleotide"
gcctccctcgcgccatcaggttccgaatcactgagtggcctggtgcctggacagagaagactgggagggggctgcagtgggactcacctgaggagacagtgaccagggtgccacggccccagagatcgaagtaccgtcgacgttccgaatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgttccgaatcactgagctgagcgggctggcaaggc

SEQ ID NO: 1969 - DNA, 495 bp, Artificial Sequence
  source: /note="Description of Artificial Sequence: Synthetic polynucleotide"
gcctccctcgcgccatcaggttccgaagagtacgttggcctggtgcctggacagagaagactgggagggggctgcagtgggactcacctgaggagacagtgaccagggtgccacggccccagagatcgaagtaccgtcgacgttccgaagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgttccgaagagtacgtctgagcgggctggcaaggc

SEQ ID NO: 1970 - DNA, 495 bp, Artificial Sequence
  source: /note="Description of Artificial Sequence: Synthetic polynucleotide"
gcctccctcgcgccatcaggttccgaaatacgccatggcctggtgcctggacagagaagactgggagggggctgcagtgggactcacctgaggagacagtgaccagggtgccacggccccagagatcgaagtaccgtcgacgttccgaaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgttccgaaatacgccactgagcgggctggcaaggc

SEQ ID NO: 1971 - DNA, 495 bp, Artificial Sequence
  source: /note="Description of Artificial Sequence: Synthetic polynucleotide"
gcctccctcgcgccatcaggttccgaatcgcatcatggcctggtgcctggacagagaagactgggagggggctgcagtgggactcacctgaggagacagtgaccagggtgccacggccccagagatcgaagtaccgtcgacgttccgaatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgttccgaatcgcatcactgagcgggctggcaaggc

SEQ ID NO: 1972 - DNA, 495 bp, Artificial Sequence
  source: /note="Description of Artificial Sequence: Synthetic polynucleotide"
gcctccctcgcgccatcaggttccgaacgcttaattggcctggtgcctggacagagaagactgggagggggctgcagtgggactcacctgaggagacagtgaccagggtgccacggccccagagatcgaagtaccgtcgacgttccgaacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgttccgaacgcttaatctgagcgggctggcaaggc

SEQ ID NO: 1973 - DNA, 495 bp, Artificial Sequence
  source: /note="Description of Artificial Sequence: Synthetic polynucleotide"
gcctccctcgcgccatcaggttccgaatggttatctggcctggtgcctggacagagaagactgggagggggctgcagtgggactcacctgaggagacagtgaccagggtgccacggccccagagatcgaagtaccgtcgacgttccgaatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgttccgaatggttatcctgagcgggctggcaaggc

SEQ ID NO: 1974 - DNA, 495 bp, Artificial Sequence
  source: /note="Description of Artificial Sequence: Synthetic polynucleotide"
gcctccctcgcgccatcaggttccgaaggattgcttggcctggtgcctggacagagaagactgggagggggctgcagtgggactcacctgaggagacagtgaccagggtgccacggccccagagatcgaagtaccgtcgacgttccgaaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgttccgaaggattgctctgagcgggctggcaaggc

SEQ ID NO: 1975 - DNA, 495 bp, Artificial Sequence
  source: /note="Description of Artificial Sequence: Synthetic polynucleotide"
gcctccctcgcgccatcaggttccgaactcagtgatggcctggtgcctggacagagaagactgggagggggctgcagtgggactcacctgaggagacagtgaccagggtgccacggccccagagatcgaagtaccgtcgacgttccgaactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgttccgaactcagtgactgagcgggctggcaaggc

SEQ ID NO: 1976 - DNA, 495 bp, Artificial Sequence
  source: /note="Description of Artificial Sequence: Synthetic polynucleotide"
gcctccctcgcgccatcaggttccgaaacgtactctggcctggtgcctggacagagaagactgggagggggctgcagtgggactcacctgaggagacagtgaccagggtgccacggccccagagatcgaagtaccgtcgacgttccgaaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgttccgaaacgtactcctgagcgggctggcaaggc

SEQ ID NO: 1977 - DNA, 495 bp, Artificial Sequence
  source: /note="Description of Artificial Sequence: Synthetic polynucleotide"
gcctccctcgcgccatcaggttccgaatgatgcgatggcctggtgcctggacagagaagactgggagggggctgcagtgggactcacctgaggagacagtgaccagggtgccacggccccagagatcgaagtaccgtcgacgttccgaatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgttccgaatgatgcgactgagcgggctggcaaggc

SEQ ID NO: 1978 - DNA, 495 bp, Artificial Sequence
  source: /note="Description of Artificial Sequence: Synthetic polynucleotide"
gcctccctcgcgccatcaggttccgaaattaagcgtggcctggtgcctggacagagaagactgggagggggctgcagtgggactcacctgaggagacagtgaccagggtgccacggccccagagatcgaagtaccgtcgacgttccgaaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgttccgaaattaagcgctgagcgggctggcaaggc

SEQ ID NO: 1979 - DNA, 495 bp, Artificial Sequence
  source: /note="Description of Artificial Sequence: Synthetic polynucleotide"
gcctccctcgcgccatcaggttccgaaagcaatcctggcctggtgcctggacagagaagactgggagggggctgcagtgggactcacctgaggagacagtgaccagggtgccacggccccagagatcgaagtaccgtcgacgttccgaaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgttccgaaagcaatccctgagcgggctggcaaggc

SEQ ID NO: 1980 - DNA, 495 bp, Artificial Sequence
  source: /note="Description of Artificial Sequence: Synthetic polynucleotide"
gcctccctcgcgccatcaggttccgaagcttagtatggcctggtgcctggacagagaagactgggagggggctgcagtgggactcacctgaggagacagtgaccagggtgccacggccccagagatcgaagtaccgtcgacgttccgaagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagttccgaagcttagtactgagcgggctggcaaggc

SEQ ID NO: 1981 - DNA, 495 bp, Artificial Sequence
  source: /note="Description of Artificial Sequence: Synthetic polynucleotide"
gcctccctcgcgccatcaggttccgaatgaccttgtggcctggtgcctggacagagaagactgggagggggctgcagtgggactcacctgaggagacagtgaccagggtgccacggccccagagatcgaagtaccgtcgacgttccgaatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgttccgaatgaccttgctgagcgggctggcaaggc

SEQ ID NO: 1982 - DNA, 495 bp, Artificial Sequence
  source: /note="Description of Artificial Sequence: Synthetic polynucleotide"
gcctccctcgcgccatcaggttccgaacaaggtcatggcctggtgcctggacagagaagactgggagggggctgcagtgggactcacctgaggagacagtgaccagggtgccacggccccagagatcgaagtaccgtcgacgttccgaacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgttccgaacaaggtcactgagcgggctggcaaggc

SEQ ID NO: 1983 - DNA, 495 bp, Artificial Sequence
  source: /note="Description of Artificial Sequence: Synthetic polynucleotide"
gcctccctcgcgccatcaggttccgaacactgtactggcctggtgcctggacagagaagactgggagggggctgcagtgggactcacctgaggagacagtgaccagggtgccacggccccagagatcgaagtaccgtcgacgttccgaacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgttccgaacactgtacctgagcgggctggcaaggc

SEQ ID NO: 1984 - DNA, 495 bp, Artificial Sequence
  source: /note="Description of Artificial Sequence: Synthetic polynucleotide"
gcctccctcgcgccatcaggttccgaagatgatcctggcctggtgcctggacagagaagactgggagggggctgcagtgggactcacctgaggagacagtgaccagggtgccacggccccagagatcgaagtaccgtcgacgttccgaagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggttccgaagatgatccctgagcgggctggcaaggc

SEQ ID NO: 1985 - DNA, 495 bp, Artificial Sequence
  source: /note="Description of Artificial Sequence: Synthetic polynucleotide"
gcctccctcgcgccatcaggttccgaacgccaatatggcctggtgcctggacagagaagactgggagggggctgcagtgggactcacctgaggagacagtgaccagggtgccacggccccagagatcgaagtaccgtcgacgttccgaacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggttccgaacgccaatactgagcgggctggcaaggc

SEQ ID NO: 1986 - DNA, 495 bp, Artificial Sequence
  source: /note="Description of Artificial Sequence: Synthetic polynucleotide"
gcctccctcgcgccatcaggttccgaatcaagccttggcctggtgcctggacagagaagactgggagggggctgcagtgggactcacctgaggagacagtgaccagggtgccacggccccagagatcgaagtaccgtcgacgttccgaatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagttccgaatcaagcctctgagcgggctggcaaggc

SEQ ID NO: 1987 - DNA, 495 bp, Artificial Sequence
  source: /note="Description of Artificial Sequence: Synthetic polynucleotide"
gcctccctcgcgccatcaggttccgaaacgtgtgttggcctggtgcctggacagagaagactgggagggggctgcagtgggactcacctgaggagacagtgaccagggtgccacggccccagagatcgaagtaccgtcgacgttccgaaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggttccgaaacgtgtgtctgagcgggctggcaaggc

SEQ ID NO: 1988 - DNA, 495 bp, Artificial Sequence
  source: /note="Description of Artificial Sequence: Synthetic polynucleotide"
gcctccctcgcgccatcaggttccgaatccgtctatggcctggtgcctggacagagaagactgggagggggctgcagtgggactcacctgaggagacagtgaccagggtgccacggccccagagatcgaagtaccgtcgacgttccgaatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggttccgaatccgtctactgagcgggctggcaaggc

SEQ ID NO: 1989 - DNA, 495 bp, Artificial Sequence
  source: /note="Description of Artificial Sequence: Synthetic polynucleotide"
gcctccctcgcgccatcaggttccgaaaagagctgtggcctggtgcctggacagagaagactgggagggggctgcagtgggactcacctgaggagacagtgaccagggtgccacggccccagagatcgaagtaccgtcgacgttccgaaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggttccgaaaagagctgctgagcgggctggcaaggc

SEQ ID NO: 1990 - DNA, 495 bp, Artificial Sequence
  source: /note="Description of Artificial Sequence: Synthetic polynucleotide"
gcctccctcgcgccatcaggttccgaatatcgctctggcctggtgcctggacagagaagactgggagggggctgcagtgggactcacctgaggagacagtgaccagggtgccacggccccagagatcgaagtaccgtcgacgttccgaatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggttccgaatatcgctcctgagcgggctggcaaggc

SEQ ID NO: 1991 - DNA, 495 bp, Artificial Sequence
  source: /note="Description of Artificial Sequence: Synthetic polynucleotide"
gcctccctcgcgccatcaggttccgaatcagatgctggcctggtgcctggacagagaagactgggagggggctgcagtgggactcacctgaggagacagtgaccagggtgccacggccccagagatcgaagtaccgtcgacgttccgaatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgttccgaatcagatgcctgagcgggctggcaaggc

SEQ ID NO: 1992 - DNA, 495 bp, Artificial Sequence
  source: /note="Description of Artificial Sequence: Synthetic polynucleotide"
gcctccctcgcgccatcaggttccgaagtgtagcatggcctggtgcctggacagagaagactgggagggggctgcagtgggactcacctgaggagacagtgaccagggtgccacggccccagagatcgaagtaccgtcgacgttccgaagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggttccgaagtgtagcactgagcgggctggcaaggc

SEQ ID NO: 1993 - DNA, 495 bp, Artificial Sequence
  source: /note="Description of Artificial Sequence: Synthetic polynucleotide"
gcctccctcgcgccatcaggttccgaatggcagtttggcctggtgcctggacagagaagactgggagggggctgcagtgggactcacctgaggagacagtgaccagggtgccacggccccagagatcgaagtaccgtcgacgttccgaatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggttccgaatggcagttctgagcgggctggcaaggc

SEQ ID NO: 1994 - DNA, 495 bp, Artificial Sequence
  source: /note="Description of Artificial Sequence: Synthetic polynucleotide"
gcctccctcgcgccatcaggttccgaacagtccaatggcctggtgcctggacagagaagactgggagggggctgcagtgggactcacctgaggagacagtgaccagggtgccacggccccagagatcgaagtaccgtcgacgttccgaacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgttccgaacagtccaactgagcgggctggcaaggc

SEQ ID NO: 1995 - DNA, 495 bp, Artificial Sequence
  source: /note="Description of Artificial Sequence: Synthetic polynucleotide"
gcctccctcgcgccatcaggttccgaagtgtctactggcctggtgcctggacagagaagactgggagggggctgcagtgggactcacctgaggagacagtgaccagggtgccacggccccagagatcgaagtaccgtcgacgttccgaagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggttccgaagtgtctacctgagcgggctggcaaggc

SEQ ID NO: 1996 - DNA, 495 bp, Artificial Sequence
  source: /note="Description of Artificial Sequence: Synthetic polynucleotide"
gcctccctcgcgccatcaggttccgaagtacagtgtggcctggtgcctggacagagaagactgggagggggctgcagtgggactcacctgaggagacagtgaccagggtgccacggccccagagatcgaagtaccgtcgacgttccgaagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggttccgaagtacagtgctgagcgggctggcaaggc

SEQ ID NO: 1997 - DNA, 495 bp, Artificial Sequence
  source: /note="Description of Artificial Sequence: Synthetic polynucleotide"
gcctccctcgcgccatcaggttccgaaggatcatctggcctggtgcctggacagagaagactgggagggggctgcagtgggactcacctgaggagacagtgaccagggtgccacggccccagagatcgaagtaccgtcgacgttccgaaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggttccgaaggatcatcctgagcgggctggcaaggc

SEQ ID NO: 1998 - DNA, 495 bp, Artificial Sequence
  source: /note="Description of Artificial Sequence: Synthetic polynucleotide"
gcctccctcgcgccatcaggttccgaatattggcgtggcctggtgcctggacagagaagactgggagggggctgcagtgggactcacctgaggagacagtgaccagggtgccacggccccagagatcgaagtaccgtcgacgttccgaatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagttccgaatattggcgctgagcgggctggcaaggc

SEQ ID NO: 1999 - DNA, 495 bp, Artificial Sequence
  source: /note="Description of Artificial Sequence: Synthetic polynucleotide"
gcctccctcgcgccatcaggttccgaaaggcttgatggcctggtgcctggacagagaagactgggagggggctgcagtgggactcacctgaggagacagtgaccagggtgccacggccccagagatcgaagtaccgtcgacgttccgaaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgttccgaaaggcttgactgagcgggctggcaaggc

SEQ ID NO: 2000 - DNA, 495 bp, Artificial Sequence
  source: /note="Description of Artificial Sequence: Synthetic polynucleotide"
gcctccctcgcgccatcaggttccgaaacacacgttggcctggtgcctggacagagaagactgggagggggctgcagtgggactcacctgaggagacagtgaccagggtgccacggccccagagatcgaagtaccgtcgacgttccgaaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgttccgaaacacacgtctgagcgggctggcaaggc

SEQ ID NO: 2001 - DNA, 495 bp, Artificial Sequence
  source: /note="Description of Artificial Sequence: Synthetic polynucleotide"
gcctccctcgcgccatcaggttccgaatagacggatggcctggtgcctggacagagaagactgggagggggctgcagtgggactcacctgaggagacagtgaccagggtgccacggccccagagatcgaagtaccgtcgacgttccgaatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagttccgaatagacggactgagcgggctggcaaggc

SEQ ID NO: 2002 - DNA, 495 bp, Artificial Sequence
  source: /note="Description of Artificial Sequence: Synthetic polynucleotide"
gcctccctcgcgccatcaggttccgaagagcgatatggcctggtgcctggacagagaagactgggagggggctgcagtgggactcacctgaggagacagtgaccagggtgccacggccccagagatcgaagtaccgtcgacgttccgaagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgttccgaagagcgatactgagcgggctggcaaggc

SEQ ID NO: 2003 - DNA, 495 bp, Artificial Sequence
  source: /note="Description of Artificial Sequence: Synthetic polynucleotide"
gcctccctcgcgccatcaggttccgaagcatctgatggcctggtgcctggacagagaagactgggagggggctgcagtgggactcacctgaggagacagtgaccagggtgccacggccccagagatcgaagtaccgtcgacgttccgaagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagttccgaagcatctgactgagcgggctggcaaggc

SEQ ID NO: 2004 - DNA, 495 bp, Artificial Sequence
  source: /note="Description of Artificial Sequence: Synthetic polynucleotide"
gcctccctcgcgccatcaggttccgaatgctacactggcctggtgcctggacagagaagactgggagggggctgcagtgggactcacctgaggagacagtgaccagggtgccacggccccagagatcgaagtaccgtcgacgttccgaatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggttccgaatgctacacctgagcgggctggcaaggc

SEQ ID NO: 2005 - DNA, 495 bp, Artificial Sequence
  source: /note="Description of Artificial Sequence: Synthetic polynucleotide"
gcctccctcgcgccatcaggttccgaaaactgccatggcctggtgcctggacagagaagactgggagggggctgcagtgggactcacctgaggagacagtgaccagggtgccacggccccagagatcgaagtaccgtcgacgttccgaaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgttccgaaaactgccactgagcgggctggcaaggc

SEQ ID NO: 2006 - DNA, 495 bp, Artificial Sequence
  source: /note="Description of Artificial Sequence: Synthetic polynucleotide"
gcctccctcgcgccatcaggttccgaattggactgtggcctggtgcctggacagagaagactgggagggggctgcagtgggactcacctgaggagacagtgaccagggtgccacggccccagagatcgaagtaccgtcgacgttccgaattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggttccgaattggactgctgagcgggctggcaaggc

SEQ ID NO: 2007 - DNA, 495 bp, Artificial Sequence
  source: /note="Description of Artificial Sequence: Synthetic polynucleotide"
gcctccctcgcgccatcaggttccgaatcggtacttggcctggtgcctggacagagaagactgggagggggctgcagtgggactcacctgaggagacagtgaccagggtgccacggccccagagatcgaagtaccgtcgacgttccgaatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggttccgaatcggtactctgagcgggctggcaaggc

SEQ ID NO: 2008 - DNA, 495 bp, Artificial Sequence
  source: /note="Description of Artificial Sequence: Synthetic polynucleotide"
gcctccctcgcgccatcaggttccgaaccatggattggcctggtgcctggacagagaagactgggagggggctgcagtgggactcacctgaggagacagtgaccagggtgccacggccccagagatcgaagtaccgtcgacgttccgaaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgttccgaaccatggatctgagcgggctggcaaggc

SEQ ID NO: 2009 - DNA, 495 bp, Artificial Sequence
  source: /note="Description of Artificial Sequence: Synthetic polynucleotide"
gcctccctcgcgccatcaggttccgaaacgaagattggcctggtgcctggacagagaagactgggagggggctgcagtgggactcacctgaggagacagtgaccagggtgccacggccccagagatcgaagtaccgtcgacgttccgaaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagttccgaaacgaagatctgagcgggctggcaaggc

SEQ ID NO: 2010 - DNA, 495 bp, Artificial Sequence
  source: /note="Description of Artificial Sequence: Synthetic polynucleotide"
gcctccctcgcgccatcaggttccgaaactgtggatggcctggtgcctggacagagaagactgggagggggctgcagtgggactcacctgaggagacagtgaccagggtgccacggccccagagatcgaagtaccgtcgacgttccgaaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgttccgaaactgtggactgagcgggctggcaaggc

SEQ ID NO: 2011 - DNA, 495 bp, Artificial Sequence
  source: /note="Description of Artificial Sequence: Synthetic polynucleotide"
gcctccctcgcgccatcaggttccgaaggtgtcattggcctggtgcctggacagagaagactgggagggggctgcagtgggactcacctgaggagacagtgaccagggtgccacggccccagagatcgaagtaccgtcgacgttccgaaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgttccgaaggtgtcatctgagcgggctggcaaggc

SEQ ID NO: 2012 - DNA, 495 bp, Artificial Sequence
  source: /note="Description of Artificial Sequence: Synthetic polynucleotide"
gcctccctcgcgccatcaggttccgaatcgtgaagtggcctggtgcctggacagagaagactgggagggggctgcagtgggactcacctgaggagacagtgaccagggtgccacggccccagagatcgaagtaccgtcgacgttccgaatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggttccgaatcgtgaagctgagcgggctggcaaggc

SEQ ID NO: 2013 - DNA, 495 bp, Artificial Sequence
  source: /note="Description of Artificial Sequence: Synthetic polynucleotide"
gcctccctcgcgccatcaggttccgaacactagcttggcctggtgcctggacagagaagactgggagggggctgcagtgggactcacctgaggagacagtgaccagggtgccacggccccagagatcgaagtaccgtcgacgttccgaacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagttccgaacactagctctgagcgggctggcaaggc

SEQ ID NO: 2014 - DNA, 495 bp, Artificial Sequence
  source: /note="Description of Artificial Sequence: Synthetic polynucleotide"
gcctccctcgcgccatcaggttccgaaggtcaacttggcctggtgcctggacagagaagactgggagggggctgcagtgggactcacctgaggagacagtgaccagggtgccacggccccagagatcgaagtaccgtcgacgttccgaaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagttccgaaggtcaactctgagcgggctggcaaggc

SEQ ID NO: 2015 - DNA, 495 bp, Artificial Sequence
  source: /note="Description of Artificial Sequence: Synthetic polynucleotide"
gcctccctcgcgccatcaggttccgaatacgtacgtggcctggtgcctggacagagaagactgggagggggctgcagtgggactcacctgaggagacagtgaccagggtgccacggccccagagatcgaagtaccgtcgacgttccgaatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgttccgaatacgtacgctgagcgggctggcaaggc

SEQ ID NO: 2016 - DNA, 495 bp, Artificial Sequence
  source: /note="Description of Artificial Sequence: Synthetic polynucleotide"
gcctccctcgcgccatcaggttccgaaatgacacctggcctggtgcctggacagagaagactgggagggggctgcagtgggactcacctgaggagacagtgaccagggtgccacggccccagagatcgaagtaccgtcgacgttccgaaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggttccgaaatgacaccctgagcgggctggcaaggc

SEQ ID NO: 2017 - DNA, 495 bp, Artificial Sequence
  source: /note="Description of Artificial Sequence: Synthetic polynucleotide"
gcctccctcgcgccatcaggttccgaacttcacgatggcctggtgcctggacagagaagactgggagggggctgcagtgggactcacctgaggagacagtgaccagggtgccacggccccagagatcgaagtaccgtcgacgttccgaacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgttccgaacttcacgactgagcgggctggcaaggc

SEQ ID NO: 2018 - DNA, 495 bp, Artificial Sequence
  source: /note="Description of Artificial Sequence: Synthetic polynucleotide"
gcctccctcgcgccatcaggttccgaaagaatcagtggcctggtgcctggacagagaagactgggagggggctgcagtgggactcacctgaggagacagtgaccagggtgccacggccccagagatcgaagtaccgtcgacgttccgaaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgttccgaaagaatcagctgagcgggctggcaaggc

SEQ ID NO: 2019 - DNA, 495 bp, Artificial Sequence
  source: /note="Description of Artificial Sequence: Synthetic polynucleotide"
gcctccctcgcgccatcaggttccgaaagttatgctggcctggtgcctggacagagaagactgggagggggctgcagtgggactcacctgaggagacagtgaccagggtgccacggccccagagatcgaagtaccgtcgacgttccgaaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagttccgaaagttatgcctgagcgggctggcaaggc

SEQ ID NO: 2020 - DNA, 495 bp, Artificial Sequence
  source: /note="Description of Artificial Sequence: Synthetic polynucleotide"
gcctccctcgcgccatcaggttccgaaaggtctcatggcctggtgcctggacagagaagactgggagggggctgcagtgggactcacctgaggagacagtgaccagggtgccacggccccagagatcgaagtaccgtcgacgttccgaaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgttccgaaaggtctcactgagcgggctggcaaggc

SEQ ID NO: 2021 - DNA, 495 bp, Artificial Sequence
  source: /note="Description of Artificial Sequence: Synthetic polynucleotide"
gcctccctcgcgccatcaggttccgaagtcatagttggcctggtgcctggacagagaagactgggagggggctgcagtgggactcacctgaggagacagtgaccagggtgccacggccccagagatcgaagtaccgtcgacgttccgaagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgttccgaagtcatagtctgagcgggctggcaaggc

SEQ ID NO: 2022 - DNA, 495 bp, Artificial Sequence
  source: /note="Description of Artificial Sequence: Synthetic polynucleotide"
gcctccctcgcgccatcaggttccgaagtgacttgtggcctggtgcctggacagagaagactgggagggggctgcagtgggactcacctgaggagacagtgaccagggtgccacggccccagagatcgaagtaccgtcgacgttccgaagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggttccgaagtgacttgctgagcgggctggcaaggc

SEQ ID NO: 2023 - DNA, 495 bp, Artificial Sequence
  source: /note="Description of Artificial Sequence: Synthetic polynucleotide"
gcctccctcgcgccatcaggttccgaagattgcagtggcctggtgcctggacagagaagactgggagggggctgcagtgggactcacctgaggagacagtgaccagggtgccacggccccagagatcgaagtaccgtcgacgttccgaagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgttccgaagattgcagctgagcgggctggcaaggc

SEQ ID NO: 2024 - DNA, 495 bp, Artificial Sequence
  source: /note="Description of Artificial Sequence: Synthetic polynucleotide"
gcctccctcgcgccatcaggttccgaaactatgactggcctggtgcctggacagagaagactgggagggggctgcagtgggactcacctgaggagacagtgaccagggtgccacggccccagagatcgaagtaccgtcgacgttccgaaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgttccgaaactatgacctgagcgggctggcaaggc

SEQ ID NO: 2025 - DNA, 495 bp, Artificial Sequence
  source: /note="Description of Artificial Sequence: Synthetic polynucleotide"
gcctccctcgcgccatcaggttccgaaatggtcaatggcctggtgcctggacagagaagactgggagggggctgcagtgggactcacctgaggagacagtgaccagggtgccacggccccagagatcgaagtaccgtcgacgttccgaaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgttccgaaatggtcaactgagcgggctggcaaggc

SEQ ID NO: 2026 - DNA, 495 bp, Artificial Sequence
  source: /note="Description of Artificial Sequence: Synthetic polynucleotide"
gcctccctcgcgccatcaggttccgaagatggctttggcctggtgcctggacagagaagactgggagggggctgcagtgggactcacctgaggagacagtgaccagggtgccacggccccagagatcgaagtaccgtcgacgttccgaagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgttccgaagatggcttctgagcgggctggcaaggc

SEQ ID NO: 2027 - DNA, 495 bp, Artificial Sequence
  source: /note="Description of Artificial Sequence: Synthetic polynucleotide"
gcctccctcgcgccatcaggttccgaaagcatatgtggcctggtgcctggacagagaagactgggagggggctgcagtgggactcacctgaggagacagtgaccagggtgccacggccccagagatcgaagtaccgtcgacgttccgaaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgttccgaaagcatatgctgagcgggctggcaaggc

SEQ ID NO: 2028 - DNA, 495 bp, Artificial Sequence
  source: /note="Description of Artificial Sequence: Synthetic polynucleotide"
gcctccctcgcgccatcaggttccgaacatatgcttggcctggtgcctggacagagaagactgggagggggctgcagtgggactcacctgaggagacagtgaccagggtgccacggccccagagatcgaagtaccgtcgacgttccgaacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggttccgaacatatgctctgagcgggctggcaaggc

SEQ ID NO: 2029 - DNA, 495 bp, Artificial Sequence
  source: /note="Description of Artificial Sequence: Synthetic polynucleotide"
gcctccctcgcgccatcaggttccgaatcgtcgattggcctggtgcctggacagagaagactgggagggggctgcagtgggactcacctgaggagacagtgaccagggtgccacggccccagagatcgaagtaccgtcgacgttccgaatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgttccgaatcgtcgatctgagcgggctggcaaggc

SEQ ID NO: 2030 - DNA, 495 bp, Artificial Sequence
  source: /note="Description of Artificial Sequence: Synthetic polynucleotide"
gcctccctcgcgccatcaggttccgaacagtctgttggcctggtgcctggacagagaagactgggagggggctgcagtgggactcacctgaggagacagtgaccagggtgccacggccccagagatcgaagtaccgtcgacgttccgaacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgttccgaacagtctgtctgagcgggctggcaaggc

SEQ ID NO: 2031 - DNA, 495 bp, Artificial Sequence
  source: /note="Description of Artificial Sequence: Synthetic polynucleotide"
gcctccctcgcgccatcaggttccgaaaacgcgtatggcctggtgcctggacagagaagactgggagggggctgcagtgggactcacctgaggagacagtgaccagggtgccacggccccagagatcgaagtaccgtcgacgttccgaaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggttccgaaaacgcgtactgagcgggctggcaaggc

SEQ ID NO: 2032 - DNA, 495 bp, Artificial Sequence
  source: /note="Description of Artificial Sequence: Synthetic polynucleotide"
gcctccctcgcgccatcaggttccgaagtagttcgtggcctggtgcctggacagagaagactgggagggggctgcagtgggactcacctgaggagacagtgaccagggtgccacggccccagagatcgaagtaccgtcgacgttccgaagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgttccgaagtagttcgctgagcgggctggcaaggc

SEQ ID NO: 2033 - DNA, 495 bp, Artificial Sequence
  source: /note="Description of Artificial Sequence: Synthetic polynucleotide"
gcctccctcgcgccatcaggttccgaacgaactactggcctggtgcctggacagagaagactgggagggggctgcagtgggactcacctgaggagacagtgaccagggtgccacggccccagagatcgaagtaccgtcgacgttccgaacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgttccgaacgaactacctgagcgggctggcaaggc

SEQ ID NO: 2034 - DNA, 495 bp, Artificial Sequence
  source: /note="Description of Artificial Sequence: Synthetic polynucleotide"
gcctccctcgcgccatcaggttccgaattaacgtctggcctggtgcctggacagagaagactgggagggggctgcagtgggactcacctgaggagacagtgaccagggtgccacggccccagagatcgaagtaccgtcgacgttccgaattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgttccgaattaacgtcctgagcgggctggcaaggc

SEQ ID NO: 2035 - DNA, 495 bp, Artificial Sequence
  source: /note="Description of Artificial Sequence: Synthetic polynucleotide"
gcctccctcgcgccatcaggttccgaaagcaaccttggcctggtgcctggacagagaagactgggagggggctgcagtgggactcacctgaggagacagtgaccagggtgccacggccccagagatcgaagtaccgtcgacgttccgaaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgttccgaaagcaacctctgagcgggctggcaaggc

SEQ ID NO: 2036 - DNA, 495 bp, Artificial Sequence
  source: /note="Description of Artificial Sequence: Synthetic polynucleotide"
gcctccctcgcgccatcaggttccgaattctcgagtggcctggtgcctggacagagaagactgggagggggctgcagtgggactcacctgaggagacagtgaccagggtgccacggccccagagatcgaagtaccgtcgacgttccgaattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgttccgaattctcgagctgagcgggctggcaaggc

SEQ ID NO: 2037 - DNA, 495 bp, Artificial Sequence
  source: /note="Description of Artificial Sequence: Synthetic polynucleotide"
gcctccctcgcgccatcaggttccgaaactctacgtggcctggtgcctggacagagaagactgggagggggctgcagtgggactcacctgaggagacagtgaccagggtgccacggccccagagatcgaagtaccgtcgacgttccgaaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgttccgaaactctacgctgagcgggctggcaaggc

SEQ ID NO: 2038 - DNA, 495 bp, Artificial Sequence
  source: /note="Description of Artificial Sequence: Synthetic polynucleotide"
gcctccctcgcgccatcaggttccgaataccggaatggcctggtgcctggacagagaagactgggagggggctgcagtgggactcacctgaggagacagtgaccagggtgccacggccccagagatcgaagtaccgtcgacgttccgaataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgttccgaataccggaactgagcgggctggcaaggc

SEQ ID NO: 2039 - DNA, 495 bp, Artificial Sequence
  source: /note="Description of Artificial Sequence: Synthetic polynucleotide"
gcctccctcgcgccatcaggttccgaacgaattgctggcctggtgcctggacagagaagactgggagggggctgcagtgggactcacctgaggagacagtgaccagggtgccacggccccagagatcgaagtaccgtcgacgttccgaacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgttccgaacgaattgcctgagcgggctggcaaggc

SEQ ID NO: 2040 - DNA, 495 bp, Artificial Sequence
  source: /note="Description of Artificial Sequence: Synthetic polynucleotide"
gcctccctcgcgccatcaggttccgaattcgctcatggcctggtgcctggacagagaagactgggagggggctgcagtgggactcacctgaggagacagtgaccagggtgccacggccccagagatcgaagtaccgtcgacgttccgaattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagttccgaattcgctcactgagcgggctggcaaggc

SEQ ID NO: 2041 - DNA, 495 bp, Artificial Sequence
  source: /note="Description of Artificial Sequence: Synthetic polynucleotide"
gcctccctcgcgccatcaggttccgaagacgttaatggcctggtgcctggacagagaagactgggagggggctgcagtgggactcacctgaggagacagtgaccagggtgccacggccccagagatcgaagtaccgtcgacgttccgaagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggttccgaagacgttaactgagcgggctggcaaggc

SEQ ID NO: 2042 - DNA, 495 bp, Artificial Sequence
  source: /note="Description of Artificial Sequence: Synthetic polynucleotide"
gcctccctcgcgccatcaggttccgaacgtagagttggcctggtgcctggacagagaagactgggagggggctgcagtgggactcacctgaggagacagtgaccagggtgccacggccccagagatcgaagtaccgtcgacgttccgaacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgttccgaacgtagagtctgagcgggctggcaaggc

SEQ ID NO: 2043 - DNA, 495 bp, Artificial Sequence
  source: /note="Description of Artificial Sequence: Synthetic polynucleotide"
gcctccctcgcgccatcaggttccgaattccggtatggcctggtgcctggacagagaagactgggagggggctgcagtgggactcacctgaggagacagtgaccagggtgccacggccccagagatcgaagtaccgtcgacgttccgaattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgttccgaattccggtactgagcgggctggcaaggc

SEQ ID NO: 2044 - DNA, 495 bp, Artificial Sequence
  source: /note="Description of Artificial Sequence: Synthetic polynucleotide"
gcctccctcgcgccatcaggttccgaagcaattcgtggcctggtgcctggacagagaagactgggagggggctgcagtgggactcacctgaggagacagtgaccagggtgccacggccccagagatcgaagtaccgtcgacgttccgaagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgttccgaagcaattcgctgagcgggctggcaaggc

SEQ ID NO: 2045 - DNA, 495 bp, Artificial Sequence
  source: /note="Description of Artificial Sequence: Synthetic polynucleotide"
gcctccctcgcgccatcaggttccgaatgagcgaatggcctggtgcctggacagagaagactgggagggggctgcagtgggactcacctgaggagacagtgaccagggtgccacggccccagagatcgaagtaccgtcgacgttccgaatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgttccgaatgagcgaactgagcgggctggcaaggc

SEQ ID NO: 2046 - DNA, 495 bp, Artificial Sequence
  source: /note="Description of Artificial Sequence: Synthetic polynucleotide"
gcctccctcgcgccatcaggttccgaatactaagctggcctggtgcctggacagagaagactgggagggggctgcagtgggactcacctgaggagacagtgaccagggtgccacggccccagagatcgaagtaccgtcgacgttccgaatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgttccgaatactaagcctgagcgggctggcaaggc

SEQ ID NO: 2047 - DNA, 495 bp, Artificial Sequence
  source: /note="Description of Artificial Sequence: Synthetic polynucleotide"
gcctccctcgcgccatcaggttccgaatggcgtattggcctggtgcctggacagagaagactgggagggggctgcagtgggactcacctgaggagacagtgaccagggtgccacggccccagagatcgaagtaccgtcgacgttccgaatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgttccgaatggcgtatctgagcgggctggcaaggc

SEQ ID NO: 2048 - DNA, 495 bp, Artificial Sequence
  source: /note="Description of Artificial Sequence: Synthetic polynucleotide"
gcctccctcgcgccatcaggttccgaagataaccatggcctggtgcctggacagagaagactgggagggggctgcagtgggactcacctgaggagacagtgaccagggtgccacggccccagagatcgaagtaccgtcgacgttccgaagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggttccgaagataaccactgagcgggctggcaaggc

SEQ ID NO: 2049 - DNA, 495 bp, Artificial Sequence
  source: /note="Description of Artificial Sequence: Synthetic polynucleotide"
gcctccctcgcgccatcaggttccgaactagtgaatggcctggtgcctggacagagaagactgggagggggctgcagtgggactcacctgaggagacagtgaccagggtgccacggccccagagatcgaagtaccgtcgacgttccgaactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggttccgaactagtgaactgagcgggctggcaaggc

SEQ ID NO: 2050 - DNA, 495 bp, Artificial Sequence
  source: /note="Description of Artificial Sequence: Synthetic polynucleotide"
gcctccctcgcgccatcaggttccgaaacgttcactggcctggtgcctggacagagaagactgggagggggctgcagtgggactcacctgaggagacagtgaccagggtgccacggccccagagatcgaagtaccgtcgacgttccgaaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgttccgaaacgttcacctgagcgggctggcaaggc

SEQ ID NO: 2051 - DNA, 448 bp, Artificial Sequence
  source: /note="Description of Artificial Sequence: Synthetic polynucleotide"
gcctccctcgcgccatcaggttccgaaattacgcttggcctggtgcctggacagagaagactgggagggggctgcagtgggactcacctgaggagacagtgaccagggtgccacggccccagagatcgaagtaccgtcgacgttccgaaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagttccgaaattacgctctgagcgggctggcaaggc

SEQ ID NO: 2052 - DNA, 495 bp, Artificial Sequence
  source: /note="Description of Artificial Sequence: Synthetic polynucleotide"
gcctccctcgcgccatcaggttccgaacattgagttggcctggtgcctggacagagaagactgggagggggctgcagtgggactcacctgaggagacagtgaccagggtgccacggccccagagatcgaagtaccgtcgacgttccgaacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgttccgaacattgagtctgagcgggctggcaaggc

SEQ ID NO: 2053 - DNA, 495 bp, Artificial Sequence
  source: /note="Description of Artificial Sequence: Synthetic polynucleotide"
gcctccctcgcgccatcagcgttacttcttggttaccaggacagaggacgctgggcccagagaaaggaggcagaaggaaagccatcttacctgaagagacggtgaccattgtcccttggccccagatatcaaaaggtcgaccgttacttcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcccgttacttcttggttactgagcgggctggcaaggc

SEQ ID NO: 2054 - DNA, 495 bp, Artificial Sequence
  source: /note="Description of Artificial Sequence: Synthetic polynucleotide"
gcctccctcgcgccatcagcgttacttacctcttgccaggacagaggacgctgggcccagagaaaggaggcagaaggaaagccatcttacctgaagagacggtgaccattgtcccttggccccagatatcaaaaggtcgaccgttacttacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacccgttacttacctcttgctgagcgggctggcaaggc

SEQ ID NO: 2055 - DNA, 495 bp, Artificial Sequence
  source: /note="Description of Artificial Sequence: Synthetic polynucleotide"
gcctccctcgcgccatcagcgttacttctgattctccaggacagaggacgctgggcccagagaaaggaggcagaaggaaagccatcttacctgaagagacggtgaccattgtcccttggccccagatatcaaaaggtcgaccgttacttctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacccgttacttctgattctctgagcgggctggcaaggc

SEQ ID NO: 2056 - DNA, 495 bp, Artificial Sequence
  source: /note="Description of Artificial Sequence: Synthetic polynucleotide"
gcctccctcgcgccatcagcgttacttagtaccgaccaggacagaggacgctgggcccagagaaaggaggcagaaggaaagccatcttacctgaagagacggtgaccattgtcccttggccccagatatcaaaaggtcgaccgttacttagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacccgttacttagtaccgactgagcgggctggcaaggc

SEQ ID NO: 2057 - DNA, 495 bp, Artificial Sequence
  source: /note="Description of Artificial Sequence: Synthetic polynucleotide"
gcctccctcgcgccatcagcgttacttatccatggccaggacagaggacgctgggcccagagaaaggaggcagaaggaaagccatcttacctgaagagacggtgaccattgtcccttggccccagatatcaaaaggtcgaccgttacttatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcccgttacttatccatggctgagcgggctggcaaggc

SEQ ID NO: 2058 - DNA, 495 bp, Artificial Sequence
  source: /note="Description of Artificial Sequence: Synthetic polynucleotide"
gcctccctcgcgccatcagcgttacttgtagcagtccaggacagaggacgctgggcccagagaaaggaggcagaaggaaagccatcttacctgaagagacggtgaccattgtcccttggccccagatatcaaaaggtcgaccgttacttgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatccgttacttgtagcagtctgagcgggctggcaaggc

SEQ ID NO: 2059 - DNA, 495 bp, Artificial Sequence
  source: /note="Description of Artificial Sequence: Synthetic polynucleotide"
gcctccctcgcgccatcagcgttacttatcttcgtccaggacagaggacgctgggcccagagaaaggaggcagaaggaaagccatcttacctgaagagacggtgaccattgtcccttggccccagatatcaaaaggtcgaccgttacttatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacccgttacttatcttcgtctgagcgggctggcaaggc

SEQ ID NO: 2060 - DNA, 495 bp, Artificial Sequence
  source: /note="Description of Artificial Sequence: Synthetic polynucleotide"
gcctccctcgcgccatcagcgttactttccacagtccaggacagaggacgctgggcccagagaaaggaggcagaaggaaagccatcttacctgaagagacggtgaccattgtcccttggccccagatatcaaaaggtcgaccgttactttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacccgttactttccacagtctgagcgggctggcaaggc

SEQ ID NO: 2061 - DNA, 495 bp, Artificial Sequence
  source: /note="Description of Artificial Sequence: Synthetic polynucleotide"
gcctccctcgcgccatcagcgttacttagctagtgccaggacagaggacgctgggcccagagaaaggaggcagaaggaaagccatcttacctgaagagacggtgaccattgtcccttggccccagatatcaaaaggtcgaccgttacttagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacccgttacttagctagtgctgagcgggctggcaaggc

SEQ ID NO: 2062 - DNA, 495 bp, Artificial Sequence
  source: /note="Description of Artificial Sequence: Synthetic polynucleotide"
gcctccctcgcgccatcagcgttactttaaccaagccaggacagaggacgctgggcccagagaaaggaggcagaaggaaagccatcttacctgaagagacggtgaccattgtcccttggccccagatatcaaaaggtcgaccgttactttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacccgttactttaaccaagctgagcgggctggcaaggc

SEQ ID NO: 2063 - DNA, 495 bp, Artificial Sequence
  source: /note="Description of Artificial Sequence: Synthetic polynucleotide"
gcctccctcgcgccatcagcgttacttcaagaggtccaggacagaggacgctgggcccagagaaaggaggcagaaggaaagccatcttacctgaagagacggtgaccattgtcccttggccccagatatcaaaaggtcgaccgttacttcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcccgttacttcaagaggtctgagcgggctggcaaggc

SEQ ID NO: 2064 - DNA, 495 bp, Artificial Sequence
  source: /note="Description of Artificial Sequence: Synthetic polynucleotide"
gcctccctcgcgccatcagcgttacttagttgaccccaggacagaggacgctgggcccagagaaaggaggcagaaggaaagccatcttacctgaagagacggtgaccattgtcccttggccccagatatcaaaaggtcgaccgttacttagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaacgttacttagttgaccctgagcgggctggcaaggc

SEQ ID NO: 2065 - DNA, 495 bp, Artificial Sequence
  source: /note="Description of Artificial Sequence: Synthetic polynucleotide"
gcctccctcgcgccatcagcgttacttcagcatatccaggacagaggacgctgggcccagagaaaggaggcagaaggaaagccatcttacctgaagagacggtgaccattgtcccttggccccagatatcaaaaggtcgaccgttacttcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaacgttacttcagcatatctgagcgggctggcaaggc

SEQ ID NO: 2066 - DNA, 495 bp, Artificial Sequence
  source: /note="Description of Artificial Sequence: Synthetic polynucleotide"
gcctccctcgcgccatcagcgttacttgcaggattccaggacagaggacgctgggcccagagaaaggaggcagaaggaaagccatcttacctgaagagacggtgaccattgtcccttggccccagatatcaaaaggtcgaccgttacttgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataacgttacttgcaggattctgagcgggctggcaaggc

SEQ ID NO: 2067 - DNA, 495 bp, Artificial Sequence
  source: /note="Description of Artificial Sequence: Synthetic polynucleotide"
gcctccctcgcgccatcagcgttacttgtccattcccaggacagaggacgctgggcccagagaaaggaggcagaaggaaagccatcttacctgaagagacggtgaccattgtcccttggccccagatatcaaaaggtcgaccgttacttgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacccgttacttgtccattcctgagcgggctggcaaggc

SEQ ID NO: 2068 - DNA, 495 bp, Artificial Sequence
  source: /note="Description of Artificial Sequence: Synthetic polynucleotide"
gcctccctcgcgccatcagcgttacttgcataactccaggacagaggacgctgggcccagagaaaggaggcagaaggaaagccatcttacctgaagagacggtgaccattgtcccttggccccagatatcaaaaggtcgaccgttacttgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggaccgttacttgcataactctgagcgggctggcaaggc

SEQ ID NO: 2069 - DNA, 495 bp, Artificial Sequence
  source: /note="Description of Artificial Sequence: Synthetic polynucleotide"
gcctccctcgcgccatcagcgttacttatatgctgccaggacagaggacgctgggcccagagaaaggaggcagaaggaaagccatcttacctgaagagacggtgaccattgtcccttggccccagatatcaaaaggtcgaccgttacttatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacccgttacttatatgctgctgagcgggctggcaaggc

SEQ ID NO: 2070 - DNA, 495 bp, Artificial Sequence
  source: /note="Description of Artificial Sequence: Synthetic polynucleotide"
gcctccctcgcgccatcagcgttacttaatcctgcccaggacagaggacgctgggcccagagaaaggaggcagaaggaaagccatcttacctgaagagacggtgaccattgtcccttggccccagatatcaaaaggtcgaccgttacttaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgccgttacttaatcctgcctgagcgggctggcaaggc

SEQ ID NO: 2071 - DNA, 495 bp, Artificial Sequence
  source: /note="Description of Artificial Sequence: Synthetic polynucleotide"
gcctccctcgcgccatcagcgttactttgagacctccaggacagaggacgctgggcccagagaaaggaggcagaaggaaagccatcttacctgaagagacggtgaccattgtcccttggccccagatatcaaaaggtcgaccgttactttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgcgttactttgagacctctgagcgggctggcaaggc

SEQ ID NO: 2072 - DNA, 495 bp, Artificial Sequence
  source: /note="Description of Artificial Sequence: Synthetic polynucleotide"
gcctccctcgcgccatcagcgttacttgaatggacccaggacagaggacgctgggcccagagaaaggaggcagaaggaaagccatcttacctgaagagacggtgaccattgtcccttggccccagatatcaaaaggtcgaccgttacttgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacccgttacttgaatggacctgagcgggctggcaaggc

SEQ ID NO: 2073 - DNA, 495 bp, Artificial Sequence
  source: /note="Description of Artificial Sequence: Synthetic polynucleotide"
gcctccctcgcgccatcagcgttacttcacatggaccaggacagaggacgctgggcccagagaaaggaggcagaaggaaagccatcttacctgaagagacggtgaccattgtcccttggccccagatatcaaaaggtcgaccgttacttcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacccgttacttcacatggactgagcgggctggcaaggc

SEQ ID NO: 2074 - DNA, 495 bp, Artificial Sequence
  source: /note="Description of Artificial Sequence: Synthetic polynucleotide"
gcctccctcgcgccatcagcgttacttttgaccatccaggacagaggacgctgggcccagagaaaggaggcagaaggaaagccatcttacctgaagagacggtgaccattgtcccttggccccagatatcaaaaggtcgaccgttacttttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacccgttacttttgaccatctgagcgggctggcaaggc

SEQ ID NO: 2075 - DNA, 495 bp, Artificial Sequence
  source: /note="Description of Artificial Sequence: Synthetic polynucleotide"
gcctccctcgcgccatcagcgttacttaagccatcccaggacagaggacgctgggcccagagaaaggaggcagaaggaaagccatcttacctgaagagacggtgaccattgtcccttggccccagatatcaaaaggtcgaccgttacttaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacccgttacttaagccatcctgagcgggctggcaaggc

SEQ ID NO: 2076 - DNA, 495 bp, Artificial Sequence
  source: /note="Description of Artificial Sequence: Synthetic polynucleotide"
gcctccctcgcgccatcagcgttactttccatgtgccaggacagaggacgctgggcccagagaaaggaggcagaaggaaagccatcttacctgaagagacggtgaccattgtcccttggccccagatatcaaaaggtcgaccgttactttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttactttccatgtgctgagcgggctggcaaggc

SEQ ID NO: 2077 - DNA, 495 bp, Artificial Sequence
  source: /note="Description of Artificial Sequence: Synthetic polynucleotide"
gcctccctcgcgccatcagcgttacttcaagtcacccaggacagaggacgctgggcccagagaaaggaggcagaaggaaagccatcttacctgaagagacggtgaccattgtcccttggccccagatatcaaaaggtcgaccgttacttcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttacttcaagtcacctgagcgggctggcaaggc

SEQ ID NO: 2078 - DNA, 495 bp, Artificial Sequence
  source: /note="Description of Artificial Sequence: Synthetic polynucleotide"
gcctccctcgcgccatcagcgttacttctgcaatcccaggacagaggacgctgggcccagagaaaggaggcagaaggaaagccatcttacctgaagagacggtgaccattgtcccttggccccagatatcaaaaggtcgaccgttacttctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacccgttacttctgcaatcctgagcgggctggcaaggc

SEQ ID NO: 2079 - DNA, 495 bp, Artificial Sequence
  source: /note="Description of Artificial Sequence: Synthetic polynucleotide"
gcctccctcgcgccatcagcgttacttatcgacgaccaggacagaggacgctgggcccagagaaaggaggcagaaggaaagccatcttacctgaagagacggtgaccattgtcccttggccccagatatcaaaaggtcgaccgttacttatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacccgttacttatcgacgactgagcgggctggcaaggc

SEQ ID NO: 2080 - DNA, 495 bp, Artificial Sequence
  source: /note="Description of Artificial Sequence: Synthetic polynucleotide"
gcctccctcgcgccatcagcgttacttacagactgccaggacagaggacgctgggcccagagaaaggaggcagaaggaaagccatcttacctgaagagacggtgaccattgtcccttggccccagatatcaaaaggtcgaccgttacttacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaacgttacttacagactgctgagcgggctggcaaggc

SEQ ID NO: 2081 - DNA, 495 bp, Artificial Sequence
  source: /note="Description of Artificial Sequence: Synthetic polynucleotide"
gcctccctcgcgccatcagcgttacttccttatagccaggacagaggacgctgggcccagagaaaggaggcagaaggaaagccatcttacctgaagagacggtgaccattgtcccttggccccagatatcaaaaggtcgaccgttacttccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggaccgttacttccttatagctgagcgggctggcaaggc

SEQ ID NO: 2082 - DNA, 495 bp, Artificial Sequence
  source: /note="Description of Artificial Sequence: Synthetic polynucleotide"
gcctccctcgcgccatcagcgttactttacgcgttccaggacagaggacgctgggcccagagaaaggaggcagaaggaaagccatcttacctgaagagacggtgaccattgtcccttggccccagatatcaaaaggtcgaccgttactttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacccgttactttacgcgttctgagcgggctggcaaggc

SEQ ID NO: 2083 - DNA, 495 bp, Artificial Sequence
  source: /note="Description of Artificial Sequence: Synthetic polynucleotide"
gcctccctcgcgccatcagcgttacttctataaggccaggacagaggacgctgggcccagagaaaggaggcagaaggaaagccatcttacctgaagagacggtgaccattgtcccttggccccagatatcaaaaggtcgaccgttacttctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgcgttacttctataaggctgagcgggctggcaaggc

SEQ ID NO: 2084 - DNA, 495 bp, Artificial Sequence
  source: /note="Description of Artificial Sequence: Synthetic polynucleotide"
gcctccctcgcgccatcagcgttactttcttagtcccaggacagaggacgctgggcccagagaaaggaggcagaaggaaagccatcttacctgaagagacggtgaccattgtcccttggccccagatatcaaaaggtcgaccgttactttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttactttcttagtcctgagcgggctggcaaggc

SEQ ID NO: 2085 - DNA, 495 bp, Artificial Sequence
  source: /note="Description of Artificial Sequence: Synthetic polynucleotide"
gcctccctcgcgccatcagcgttactttgtctgcaccaggacagaggacgctgggcccagagaaaggaggcagaaggaaagccatcttacctgaagagacggtgaccattgtcccttggccccagatatcaaaaggtcgaccgttactttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacccgttactttgtctgcactgagcgggctggcaaggc

SEQ ID NO: 2086 - DNA, 495 bp, Artificial Sequence
  source: /note="Description of Artificial Sequence: Synthetic polynucleotide"
gcctccctcgcgccatcagcgttacttgccattaaccaggacagaggacgctgggcccagagaaaggaggcagaaggaaagccatcttacctgaagagacggtgaccattgtcccttggccccagatatcaaaaggtcgaccgttacttgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttacttgccattaactgagcgggctggcaaggc

SEQ ID NO: 2087 - DNA, 495 bp, Artificial Sequence
  source: /note="Description of Artificial Sequence: Synthetic polynucleotide"
gcctccctcgcgccatcagcgttacttgactaagaccaggacagaggacgctgggcccagagaaaggaggcagaaggaaagccatcttacctgaagagacggtgaccattgtcccttggccccagatatcaaaaggtcgaccgttacttgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgcgttacttgactaagactgagcgggctggcaaggc

SEQ ID NO: 2088 - DNA, 495 bp, Artificial Sequence
  source: /note="Description of Artificial Sequence: Synthetic polynucleotide"
gcctccctcgcgccatcagcgttacttaggttgctccaggacagaggacgctgggcccagagaaaggaggcagaaggaaagccatcttacctgaagagacggtgaccattgtcccttggccccagatatcaaaaggtcgaccgttacttaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgcgttacttaggttgctctgagcgggctggcaaggc

SEQ ID NO: 2089 - DNA, 495 bp, Artificial Sequence
  source: /note="Description of Artificial Sequence: Synthetic polynucleotide"
gcctccctcgcgccatcagcgttacttctcgagaaccaggacagaggacgctgggcccagagaaaggaggcagaaggaaagccatcttacctgaagagacggtgaccattgtcccttggccccagatatcaaaaggtcgaccgttacttctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacccgttacttctcgagaactgagcgggctggcaaggc

SEQ ID NO: 2090 - DNA, 495 bp, Artificial Sequence
  source: /note="Description of Artificial Sequence: Synthetic polynucleotide"
gcctccctcgcgccatcagcgttacttttaatggcccaggacagaggacgctgggcccagagaaaggaggcagaaggaaagccatcttacctgaagagacggtgaccattgtcccttggccccagatatcaaaaggtcgaccgttacttttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacccgttacttttaatggcctgagcgggctggcaaggc

SEQ ID NO: 2091 - DNA, 495 bp, Artificial Sequence
  source: /note="Description of Artificial Sequence: Synthetic polynucleotide"
gcctccctcgcgccatcagcgttactttgcagacaccaggacagaggacgctgggcccagagaaaggaggcagaaggaaagccatcttacctgaagagacggtgaccattgtcccttggccccagatatcaaaaggtcgaccgttactttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaacgttactttgcagacactgagcgggctggcaaggc

SEQ ID NO: 2092 - DNA, 495 bp, Artificial Sequence
  source: /note="Description of Artificial Sequence: Synthetic polynucleotide"
gcctccctcgcgccatcagcgttactttcactgagccaggacagaggacgctgggcccagagaaaggaggcagaaggaaagccatcttacctgaagagacggtgaccattgtcccttggccccagatatcaaaaggtcgaccgttactttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtcgttactttcactgagctgagcgggctggcaaggc

SEQ ID NO: 2093 - DNA, 495 bp, Artificial Sequence
  source: /note="Description of Artificial Sequence: Synthetic polynucleotide"
gcctccctcgcgccatcagcgttacttgagtacgtccaggacagaggacgctgggcccagagaaaggaggcagaaggaaagccatcttacctgaagagacggtgaccattgtcccttggccccagatatcaaaaggtcgaccgttacttgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccaccgttacttgagtacgtctgagcgggctggcaaggc

SEQ ID NO: 2094 - DNA, 495 bp, Artificial Sequence
  source: /note="Description of Artificial Sequence: Synthetic polynucleotide"
gcctccctcgcgccatcagcgttacttatacgccaccaggacagaggacgctgggcccagagaaaggaggcagaaggaaagccatcttacctgaagagacggtgaccattgtcccttggccccagatatcaaaaggtcgaccgttacttatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggaccgttacttatacgccactgagcgggctggcaaggc

SEQ ID NO: 2095 - DNA, 495 bp, Artificial Sequence
  source: /note="Description of Artificial Sequence: Synthetic polynucleotide"
gcctccctcgcgccatcagcgttactttcgcatcaccaggacagaggacgctgggcccagagaaaggaggcagaaggaaagccatcttacctgaagagacggtgaccattgtcccttggccccagatatcaaaaggtcgaccgttactttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggaccgttactttcgcatcactgagcgggctggcaaggc

SEQ ID NO: 2096 - DNA, 495 bp, Artificial Sequence
  source: /note="Description of Artificial Sequence: Synthetic polynucleotide"
gcctccctcgcgccatcagcgttacttcgcttaatccaggacagaggacgctgggcccagagaaaggaggcagaaggaaagccatcttacctgaagagacggtgaccattgtcccttggccccagatatcaaaaggtcgaccgttacttcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggaccgttacttcgcttaatctgagcgggctggcaaggc

SEQ ID NO: 2097 - DNA, 495 bp, Artificial Sequence
  source: /note="Description of Artificial Sequence: Synthetic polynucleotide"
gcctccctcgcgccatcagcgttactttggttatcccaggacagaggacgctgggcccagagaaaggaggcagaaggaaagccatcttacctgaagagacggtgaccattgtcccttggccccagatatcaaaaggtcgaccgttactttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtcgttactttggttatcctgagcgggctggcaaggc

SEQ ID NO: 2098 - DNA, 495 bp, Artificial Sequence
  source: /note="Description of Artificial Sequence: Synthetic polynucleotide"
gcctccctcgcgccatcagcgttacttggattgctccaggacagaggacgctgggcccagagaaaggaggcagaaggaaagccatcttacctgaagagacggtgaccattgtcccttggccccagatatcaaaaggtcgaccgttacttggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggaccgttacttggattgctctgagcgggctggcaaggc

SEQ ID NO: 2099 - DNA, 495 bp, Artificial Sequence
  source: /note="Description of Artificial Sequence: Synthetic polynucleotide"
gcctccctcgcgccatcagcgttacttctcagtgaccaggacagaggacgctgggcccagagaaaggaggcagaaggaaagccatcttacctgaagagacggtgaccattgtcccttggccccagatatcaaaaggtcgaccgttacttctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtcgttacttctcagtgactgagcgggctggcaaggc

SEQ ID NO: 2100 - DNA, 495 bp, Artificial Sequence
  source: /note="Description of Artificial Sequence: Synthetic polynucleotide"
gcctccctcgcgccatcagcgttacttacgtactcccaggacagaggacgctgggcccagagaaaggaggcagaaggaaagccatcttacctgaagagacggtgaccattgtcccttggccccagatatcaaaaggtcgaccgttacttacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggaccgttacttacgtactcctgagcgggctggcaaggc

SEQ ID NO: 2101 - DNA, 495 bp, Artificial Sequence
  source: /note="Description of Artificial Sequence: Synthetic polynucleotide"
gcctccctcgcgccatcagcgttactttgatgcgaccaggacagaggacgctgggcccagagaaaggaggcagaaggaaagccatcttacctgaagagacggtgaccattgtcccttggccccagatatcaaaaggtcgaccgttactttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccccgttactttgatgcgactgagcgggctggcaaggc

SEQ ID NO: 2102 - DNA, 495 bp, Artificial Sequence
  source: /note="Description of Artificial Sequence: Synthetic polynucleotide"
gcctccctcgcgccatcagcgttacttattaagcgccaggacagaggacgctgggcccagagaaaggaggcagaaggaaagccatcttacctgaagagacggtgaccattgtcccttggccccagatatcaaaaggtcgaccgttacttattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcccgttacttattaagcgctgagcgggctggcaaggc

SEQ ID NO: 2103 - DNA, 495 bp, Artificial Sequence
  source: /note="Description of Artificial Sequence: Synthetic polynucleotide"
gcctccctcgcgccatcagcgttacttagcaatccccaggacagaggacgctgggcccagagaaaggaggcagaaggaaagccatcttacctgaagagacggtgaccattgtcccttggccccagatatcaaaaggtcgaccgttacttagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcccgttacttagcaatccctgagcgggctggcaaggc

SEQ ID NO: 2104 - DNA, 495 bp, Artificial Sequence
  source: /note="Description of Artificial Sequence: Synthetic polynucleotide"
gcctccctcgcgccatcagcgttacttgcttagtaccaggacagaggacgctgggcccagagaaaggaggcagaaggaaagccatcttacctgaagagacggtgaccattgtcccttggccccagatatcaaaaggtcgaccgttacttgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgacgttacttgcttagtactgagcgggctggcaaggc

SEQ ID NO: 2105 - DNA, 495 bp, Artificial Sequence
  source: /note="Description of Artificial Sequence: Synthetic polynucleotide"
gcctccctcgcgccatcagcgttactttgaccttgccaggacagaggacgctgggcccagagaaaggaggcagaaggaaagccatcttacctgaagagacggtgaccattgtcccttggccccagatatcaaaaggtcgaccgttactttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacccgttactttgaccttgctgagcgggctggcaaggc

SEQ ID NO: 2106 - DNA, 495 bp, Artificial Sequence
  source: /note="Description of Artificial Sequence: Synthetic polynucleotide"
gcctccctcgcgccatcagcgttacttcaaggtcaccaggacagaggacgctgggcccagagaaaggaggcagaaggaaagccatcttacctgaagagacggtgaccattgtcccttggccccagatatcaaaaggtcgaccgttacttcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacccgttacttcaaggtcactgagcgggctggcaaggc

SEQ ID NO: 2107 - DNA, 495 bp, Artificial Sequence
  source: /note="Description of Artificial Sequence: Synthetic polynucleotide"
gcctccctcgcgccatcagcgttacttcactgtacccaggacagaggacgctgggcccagagaaaggaggcagaaggaaagccatcttacctgaagagacggtgaccattgtcccttggccccagatatcaaaaggtcgaccgttacttcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttccgttacttcactgtacctgagcgggctggcaaggc

SEQ ID NO: 2108 - DNA, 495 bp, Artificial Sequence
  source: /note="Description of Artificial Sequence: Synthetic polynucleotide"
gcctccctcgcgccatcagcgttacttgatgatccccaggacagaggacgctgggcccagagaaaggaggcagaaggaaagccatcttacctgaagagacggtgaccattgtcccttggccccagatatcaaaaggtcgaccgttacttgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggcgttacttgatgatccctgagcgggctggcaaggc

SEQ ID NO: 2109 - DNA, 495 bp, Artificial Sequence
  source: /note="Description of Artificial Sequence: Synthetic polynucleotide"
gcctccctcgcgccatcagcgttacttcgccaataccaggacagaggacgctgggcccagagaaaggaggcagaaggaaagccatcttacctgaagagacggtgaccattgtcccttggccccagatatcaaaaggtcgaccgttacttcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggcgttacttcgccaatactgagcgggctggcaaggc

SEQ ID NO: 2110 - DNA, 495 bp, Artificial Sequence
  source: /note="Description of Artificial Sequence: Synthetic polynucleotide"
gcctccctcgcgccatcagcgttactttcaagcctccaggacagaggacgctgggcccagagaaaggaggcagaaggaaagccatcttacctgaagagacggtgaccattgtcccttggccccagatatcaaaaggtcgaccgttactttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacacgttactttcaagcctctgagcgggctggcaaggc

SEQ ID NO: 2111 - DNA, 495 bp, Artificial Sequence
  source: /note="Description of Artificial Sequence: Synthetic polynucleotide"
gcctccctcgcgccatcagcgttacttacgtgtgtccaggacagaggacgctgggcccagagaaaggaggcagaaggaaagccatcttacctgaagagacggtgaccattgtcccttggccccagatatcaaaaggtcgaccgttacttacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagcgttacttacgtgtgtctgagcgggctggcaaggc

SEQ ID NO: 2112 - DNA, 495 bp, Artificial Sequence
  source: /note="Description of Artificial Sequence: Synthetic polynucleotide"
gcctccctcgcgccatcagcgttactttccgtctaccaggacagaggacgctgggcccagagaaaggaggcagaaggaaagccatcttacctgaagagacggtgaccattgtcccttggccccagatatcaaaaggtcgaccgttactttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagcgttactttccgtctactgagcgggctggcaaggc

SEQ ID NO: 2113 - DNA, 495 bp, Artificial Sequence
  source: /note="Description of Artificial Sequence: Synthetic polynucleotide"
gcctccctcgcgccatcagcgttacttaagagctgccaggacagaggacgctgggcccagagaaaggaggcagaaggaaagccatcttacctgaagagacggtgaccattgtcccttggccccagatatcaaaaggtcgaccgttacttaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgcgttacttaagagctgctgagcgggctggcaaggc

SEQ ID NO: 2114 - DNA, 495 bp, Artificial Sequence
  source: /note="Description of Artificial Sequence: Synthetic polynucleotide"
gcctccctcgcgccatcagcgttactttatcgctcccaggacagaggacgctgggcccagagaaaggaggcagaaggaaagccatcttacctgaagagacggtgaccattgtcccttggccccagatatcaaaaggtcgaccgttactttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagcgttactttatcgctcctgagcgggctggcaaggc

SEQ ID NO: 2115 - DNA, 495 bp, Artificial Sequence
  source: /note="Description of Artificial Sequence: Synthetic polynucleotide"
gcctccctcgcgccatcagcgttactttcagatgcccaggacagaggacgctgggcccagagaaaggaggcagaaggaaagccatcttacctgaagagacggtgaccattgtcccttggccccagatatcaaaaggtcgaccgttactttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccccgttactttcagatgcctgagcgggctggcaaggc

SEQ ID NO: 2116 - DNA, 495 bp, Artificial Sequence
  source: /note="Description of Artificial Sequence: Synthetic polynucleotide"
gcctccctcgcgccatcagcgttacttgtgtagcaccaggacagaggacgctgggcccagagaaaggaggcagaaggaaagccatcttacctgaagagacggtgaccattgtcccttggccccagatatcaaaaggtcgaccgttacttgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgcgttacttgtgtagcactgagcgggctggcaaggc

SEQ ID NO: 2117 - DNA, 495 bp, Artificial Sequence
  source: /note="Description of Artificial Sequence: Synthetic polynucleotide"
gcctccctcgcgccatcagcgttactttggcagttccaggacagaggacgctgggcccagagaaaggaggcagaaggaaagccatcttacctgaagagacggtgaccattgtcccttggccccagatatcaaaaggtcgaccgttactttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgcgttactttggcagttctgagcgggctggcaaggc

SEQ ID NO: 2118 - DNA, 495 bp, Artificial Sequence
  source: /note="Description of Artificial Sequence: Synthetic polynucleotide"
gcctccctcgcgccatcagcgttacttcagtccaaccaggacagaggacgctgggcccagagaaaggaggcagaaggaaagccatcttacctgaagagacggtgaccattgtcccttggccccagatatcaaaaggtcgaccgttacttcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcaccgttacttcagtccaactgagcgggctggcaaggc

SEQ ID NO: 2119 - DNA, 495 bp, Artificial Sequence
  source: /note="Description of Artificial Sequence: Synthetic polynucleotide"
gcctccctcgcgccatcagcgttacttgtgtctacccaggacagaggacgctgggcccagagaaaggaggcagaaggaaagccatcttacctgaagagacggtgaccattgtcccttggccccagatatcaaaaggtcgaccgttacttgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggcgttacttgtgtctacctgagcgggctggcaaggc

SEQ ID NO: 2120 - DNA, 495 bp, Artificial Sequence
  source: /note="Description of Artificial Sequence: Synthetic polynucleotide"
gcctccctcgcgccatcagcgttacttgtacagtgccaggacagaggacgctgggcccagagaaaggaggcagaaggaaagccatcttacctgaagagacggtgaccattgtcccttggccccagatatcaaaaggtcgaccgttacttgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagcgttacttgtacagtgctgagcgggctggcaaggc

SEQ ID NO: 2121 - DNA, 495 bp, Artificial Sequence
  source: /note="Description of Artificial Sequence: Synthetic polynucleotide"
gcctccctcgcgccatcagcgttacttggatcatcccaggacagaggacgctgggcccagagaaaggaggcagaaggaaagccatcttacctgaagagacggtgaccattgtcccttggccccagatatcaaaaggtcgaccgttacttggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagcgttacttggatcatcctgagcgggctggcaaggc

SEQ ID NO: 2122 - DNA, 495 bp, Artificial Sequence
  source: /note="Description of Artificial Sequence: Synthetic polynucleotide"
gcctccctcgcgccatcagcgttactttattggcgccaggacagaggacgctgggcccagagaaaggaggcagaaggaaagccatcttacctgaagagacggtgaccattgtcccttggccccagatatcaaaaggtcgaccgttactttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcacgttactttattggcgctgagcgggctggcaaggc

SEQ ID NO: 2123 - DNA, 495 bp, Artificial Sequence
  source: /note="Description of Artificial Sequence: Synthetic polynucleotide"
gcctccctcgcgccatcagcgttacttaggcttgaccaggacagaggacgctgggcccagagaaaggaggcagaaggaaagccatcttacctgaagagacggtgaccattgtcccttggccccagatatcaaaaggtcgaccgttacttaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcaccgttacttaggcttgactgagcgggctggcaaggc

SEQ ID NO: 2124 - DNA, 495 bp, Artificial Sequence
  source: /note="Description of Artificial Sequence: Synthetic polynucleotide"
gcctccctcgcgccatcagcgttacttacacacgtccaggacagaggacgctgggcccagagaaaggaggcagaaggaaagccatcttacctgaagagacggtgaccattgtcccttggccccagatatcaaaaggtcgaccgttacttacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatcgttacttacacacgtctgagcgggctggcaaggc

SEQ ID NO: 2125 - DNA, 495 bp, Artificial Sequence
  source: /note="Description of Artificial Sequence: Synthetic polynucleotide"
gcctccctcgcgccatcagcgttactttagacggaccaggacagaggacgctgggcccagagaaaggaggcagaaggaaagccatcttacctgaagagacggtgaccattgtcccttggccccagatatcaaaaggtcgaccgttactttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgacgttactttagacggactgagcgggctggcaaggc

SEQ ID NO: 2126 - DNA, 495 bp, Artificial Sequence
  source: /note="Description of Artificial Sequence: Synthetic polynucleotide"
gcctccctcgcgccatcagcgttacttgagcgataccaggacagaggacgctgggcccagagaaaggaggcagaaggaaagccatcttacctgaagagacggtgaccattgtcccttggccccagatatcaaaaggtcgaccgttacttgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttcgttacttgagcgatactgagcgggctggcaaggc

SEQ ID NO: 2127 - DNA, 495 bp, Artificial Sequence
  source: /note="Description of Artificial Sequence: Synthetic polynucleotide"
gcctccctcgcgccatcagcgttacttgcatctgaccaggacagaggacgctgggcccagagaaaggaggcagaaggaaagccatcttacctgaagagacggtgaccattgtcccttggccccagatatcaaaaggtcgaccgttacttgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacacgttacttgcatctgactgagcgggctggcaaggc

SEQ ID NO: 2128 - DNA, 495 bp, Artificial Sequence
  source: /note="Description of Artificial Sequence: Synthetic polynucleotide"
gcctccctcgcgccatcagcgttactttgctacacccaggacagaggacgctgggcccagagaaaggaggcagaaggaaagccatcttacctgaagagacggtgaccattgtcccttggccccagatatcaaaaggtcgaccgttactttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgcgttactttgctacacctgagcgggctggcaaggc

SEQ ID NO: 2129 - DNA, 495 bp, Artificial Sequence
  source: /note="Description of Artificial Sequence: Synthetic polynucleotide"
gcctccctcgcgccatcagcgttacttaactgccaccaggacagaggacgctgggcccagagaaaggaggcagaaggaaagccatcttacctgaagagacggtgaccattgtcccttggccccagatatcaaaaggtcgaccgttacttaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttcgttacttaactgccactgagcgggctggcaaggc

SEQ ID NO: 2130 - DNA, 495 bp, Artificial Sequence
  source: /note="Description of Artificial Sequence: Synthetic polynucleotide"
gcctccctcgcgccatcagcgttacttttggactgccaggacagaggacgctgggcccagagaaaggaggcagaaggaaagccatcttacctgaagagacggtgaccattgtcccttggccccagatatcaaaaggtcgaccgttacttttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggcgttacttttggactgctgagcgggctggcaaggc

SEQ ID NO: 2131 - DNA, 495 bp, Artificial Sequence
  source: /note="Description of Artificial Sequence: Synthetic polynucleotide"
gcctccctcgcgccatcagcgttactttcggtactccaggacagaggacgctgggcccagagaaaggaggcagaaggaaagccatcttacctgaagagacggtgaccattgtcccttggccccagatatcaaaaggtcgaccgttactttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgcgttactttcggtactctgagcgggctggcaaggc

SEQ ID NO: 2132 - DNA, 495 bp, Artificial Sequence
  source: /note="Description of Artificial Sequence: Synthetic polynucleotide"
gcctccctcgcgccatcagcgttacttccatggatccaggacagaggacgctgggcccagagaaaggaggcagaaggaaagccatcttacctgaagagacggtgaccattgtcccttggccccagatatcaaaaggtcgaccgttacttccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggataccgttacttccatggatctgagcgggctggcaaggc

SEQ ID NO: 2133 - DNA, 495 bp, Artificial Sequence
  source: /note="Description of Artificial Sequence: Synthetic polynucleotide"
gcctccctcgcgccatcagcgttacttacgaagatccaggacagaggacgctgggcccagagaaaggaggcagaaggaaagccatcttacctgaagagacggtgaccattgtcccttggccccagatatcaaaaggtcgaccgttacttacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaacgttacttacgaagatctgagcgggctggcaaggc

SEQ ID NO: 2134 - DNA, 495 bp, Artificial Sequence
  source: /note="Description of Artificial Sequence: Synthetic polynucleotide"
gcctccctcgcgccatcagcgttacttactgtggaccaggacagaggacgctgggcccagagaaaggaggcagaaggaaagccatcttacctgaagagacggtgaccattgtcccttggccccagatatcaaaaggtcgaccgttacttactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttcgttacttactgtggactgagcgggctggcaaggc

SEQ ID NO: 2135 - DNA, 495 bp, Artificial Sequence
  source: /note="Description of Artificial Sequence: Synthetic polynucleotide"
gcctccctcgcgccatcagcgttacttggtgtcatccaggacagaggacgctgggcccagagaaaggaggcagaaggaaagccatcttacctgaagagacggtgaccattgtcccttggccccagatatcaaaaggtcgaccgttacttggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctcgttacttggtgtcatctgagcgggctggcaaggc

SEQ ID NO: 2136 - DNA, 495 bp, Artificial Sequence
  source: /note="Description of Artificial Sequence: Synthetic polynucleotide"
gcctccctcgcgccatcagcgttactttcgtgaagccaggacagaggacgctgggcccagagaaaggaggcagaaggaaagccatcttacctgaagagacggtgaccattgtcccttggccccagatatcaaaaggtcgaccgttactttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggcgttactttcgtgaagctgagcgggctggcaaggc

SEQ ID NO: 2137 - DNA, 495 bp, Artificial Sequence
  source: /note="Description of Artificial Sequence: Synthetic polynucleotide"
gcctccctcgcgccatcagcgttacttcactagctccaggacagaggacgctgggcccagagaaaggaggcagaaggaaagccatcttacctgaagagacggtgaccattgtcccttggccccagatatcaaaaggtcgaccgttacttcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaacgttacttcactagctctgagcgggctggcaaggc

SEQ ID NO: 2138 - DNA, 495 bp, Artificial Sequence
  source: /note="Description of Artificial Sequence: Synthetic polynucleotide"
gcctccctcgcgccatcagcgttacttggtcaactccaggacagaggacgctgggcccagagaaaggaggcagaaggaaagccatcttacctgaagagacggtgaccattgtcccttggccccagatatcaaaaggtcgaccgttacttggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggacgttacttggtcaactctgagcgggctggcaaggc

SEQ ID NO: 2139 - DNA, 495 bp, Artificial Sequence
  source: /note="Description of Artificial Sequence: Synthetic polynucleotide"
gcctccctcgcgccatcagcgttactttacgtacgccaggacagaggacgctgggcccagagaaaggaggcagaaggaaagccatcttacctgaagagacggtgaccattgtcccttggccccagatatcaaaaggtcgaccgttactttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatccgttactttacgtacgctgagcgggctggcaaggc

SEQ ID NO: 2140 - DNA, 495 bp, Artificial Sequence
  source: /note="Description of Artificial Sequence: Synthetic polynucleotide"
gcctccctcgcgccatcagcgttacttatgacaccccaggacagaggacgctgggcccagagaaaggaggcagaaggaaagccatcttacctgaagagacggtgaccattgtcccttggccccagatatcaaaaggtcgaccgttacttatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggcgttacttatgacaccctgagcgggctggcaaggc

SEQ ID NO: 2141 - DNA, 495 bp, Artificial Sequence
  source: /note="Description of Artificial Sequence: Synthetic polynucleotide"
gcctccctcgcgccatcagcgttacttcttcacgaccaggacagaggacgctgggcccagagaaaggaggcagaaggaaagccatcttacctgaagagacggtgaccattgtcccttggccccagatatcaaaaggtcgaccgttacttcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacaccgttacttcttcacgactgagcgggctggcaaggc

SEQ ID NO: 2142 - DNA, 495 bp, Artificial Sequence
  source: /note="Description of Artificial Sequence: Synthetic polynucleotide"
gcctccctcgcgccatcagcgttacttagaatcagccaggacagaggacgctgggcccagagaaaggaggcagaaggaaagccatcttacctgaagagacggtgaccattgtcccttggccccagatatcaaaaggtcgaccgttacttagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacccgttacttagaatcagctgagcgggctggcaaggc

SEQ ID NO: 2143 - DNA, 495 bp, Artificial Sequence
  source: /note="Description of Artificial Sequence: Synthetic polynucleotide"
gcctccctcgcgccatcagcgttacttagttatgcccaggacagaggacgctgggcccagagaaaggaggcagaaggaaagccatcttacctgaagagacggtgaccattgtcccttggccccagatatcaaaaggtcgaccgttacttagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataacgttacttagttatgcctgagcgggctggcaaggc

SEQ ID NO: 2144 - DNA, 495 bp, Artificial Sequence
  source: /note="Description of Artificial Sequence: Synthetic polynucleotide"
gcctccctcgcgccatcagcgttacttaggtctcaccaggacagaggacgctgggcccagagaaaggaggcagaaggaaagccatcttacctgaagagacggtgaccattgtcccttggccccagatatcaaaaggtcgaccgttacttaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacccgttacttaggtctcactgagcgggctggcaaggc

SEQ ID NO: 2145 - DNA, 495 bp, Artificial Sequence
  source: /note="Description of Artificial Sequence: Synthetic polynucleotide"
gcctccctcgcgccatcagcgttacttgtcatagtccaggacagaggacgctgggcccagagaaaggaggcagaaggaaagccatcttacctgaagagacggtgaccattgtcccttggccccagatatcaaaaggtcgaccgttacttgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtcgttacttgtcatagtctgagcgggctggcaaggc

SEQ ID NO: 2146 - DNA, 495 bp, Artificial Sequence
  source: /note="Description of Artificial Sequence: Synthetic polynucleotide"
gcctccctcgcgccatcagcgttacttgtgacttgccaggacagaggacgctgggcccagagaaaggaggcagaaggaaagccatcttacctgaagagacggtgaccattgtcccttggccccagatatcaaaaggtcgaccgttacttgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgcgttacttgtgacttgctgagcgggctggcaaggc

SEQ ID NO: 2147 - DNA, 495 bp, Artificial Sequence
  source: /note="Description of Artificial Sequence: Synthetic polynucleotide"
gcctccctcgcgccatcagcgttacttgattgcagccaggacagaggacgctgggcccagagaaaggaggcagaaggaaagccatcttacctgaagagacggtgaccattgtcccttggccccagatatcaaaaggtcgaccgttacttgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacccgttacttgattgcagctgagcgggctggcaaggc

SEQ ID NO: 2148 - DNA, 495 bp, Artificial Sequence
  source: /note="Description of Artificial Sequence: Synthetic polynucleotide"
gcctccctcgcgccatcagcgttacttactatgacccaggacagaggacgctgggcccagagaaaggaggcagaaggaaagccatcttacctgaagagacggtgaccattgtcccttggccccagatatcaaaaggtcgaccgttacttactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaaccgttacttactatgacctgagcgggctggcaaggc

SEQ ID NO: 2149 - DNA, 495 bp, Artificial Sequence
  source: /note="Description of Artificial Sequence: Synthetic polynucleotide"
gcctccctcgcgccatcagcgttacttatggtcaaccaggacagaggacgctgggcccagagaaaggaggcagaaggaaagccatcttacctgaagagacggtgaccattgtcccttggccccagatatcaaaaggtcgaccgttacttatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagaccgttacttatggtcaactgagcgggctggcaaggc

SEQ ID NO: 2150 - DNA, 495 bp, Artificial Sequence
  source: /note="Description of Artificial Sequence: Synthetic polynucleotide"
gcctccctcgcgccatcagcgttacttgatggcttccaggacagaggacgctgggcccagagaaaggaggcagaaggaaagccatcttacctgaagagacggtgaccattgtcccttggccccagatatcaaaaggtcgaccgttacttgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaaccgttacttgatggcttctgagcgggctggcaaggc

SEQ ID NO: 2151 - DNA, 495 bp, Artificial Sequence
  source: /note="Description of Artificial Sequence: Synthetic polynucleotide"
gcctccctcgcgccatcagcgttacttagcatatgccaggacagaggacgctgggcccagagaaaggaggcagaaggaaagccatcttacctgaagagacggtgaccattgtcccttggccccagatatcaaaaggtcgaccgttacttagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagaccgttacttagcatatgctgagcgggctggcaaggc

SEQ ID NO: 2152 - DNA, 495 bp, Artificial Sequence
  source: /note="Description of Artificial Sequence: Synthetic polynucleotide"
gcctccctcgcgccatcagcgttacttcatatgctccaggacagaggacgctgggcccagagaaaggaggcagaaggaaagccatcttacctgaagagacggtgaccattgtcccttggccccagatatcaaaaggtcgaccgttacttcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgcgttacttcatatgctctgagcgggctggcaaggc

SEQ ID NO: 2153 - DNA, 495 bp, Artificial Sequence
  source: /note="Description of Artificial Sequence: Synthetic polynucleotide"
gcctccctcgcgccatcagcgttactttcgtcgatccaggacagaggacgctgggcccagagaaaggaggcagaaggaaagccatcttacctgaagagacggtgaccattgtcccttggccccagatatcaaaaggtcgaccgttactttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacccgttactttcgtcgatctgagcgggctggcaaggc

SEQ ID NO: 2154 - DNA, 495 bp, Artificial Sequence
  source: /note="Description of Artificial Sequence: Synthetic polynucleotide"
gcctccctcgcgccatcagcgttacttcagtctgtccaggacagaggacgctgggcccagagaaaggaggcagaaggaaagccatcttacctgaagagacggtgaccattgtcccttggccccagatatcaaaaggtcgaccgttacttcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgccgttacttcagtctgtctgagcgggctggcaaggc

SEQ ID NO: 2155 - DNA, 495 bp, Artificial Sequence
  source: /note="Description of Artificial Sequence: Synthetic polynucleotide"
gcctccctcgcgccatcagcgttacttaacgcgtaccaggacagaggacgctgggcccagagaaaggaggcagaaggaaagccatcttacctgaagagacggtgaccattgtcccttggccccagatatcaaaaggtcgaccgttacttaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgcgttacttaacgcgtactgagcgggctggcaaggc

SEQ ID NO: 2156 - DNA, 495 bp, Artificial Sequence
  source: /note="Description of Artificial Sequence: Synthetic polynucleotide"
gcctccctcgcgccatcagcgttacttgtagttcgccaggacagaggacgctgggcccagagaaaggaggcagaaggaaagccatcttacctgaagagacggtgaccattgtcccttggccccagatatcaaaaggtcgaccgttacttgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgccgttacttgtagttcgctgagcgggctggcaaggc

SEQ ID NO: 2157 - DNA, 495 bp, Artificial Sequence
  source: /note="Description of Artificial Sequence: Synthetic polynucleotide"
gcctccctcgcgccatcagcgttacttcgaactacccaggacagaggacgctgggcccagagaaaggaggcagaaggaaagccatcttacctgaagagacggtgaccattgtcccttggccccagatatcaaaaggtcgaccgttacttcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagaccgttacttcgaactacctgagcgggctggcaaggc

SEQ ID NO: 2158 - DNA, 495 bp, Artificial Sequence
  source: /note="Description of Artificial Sequence: Synthetic polynucleotide"
gcctccctcgcgccatcagcgttacttttaacgtcccaggacagaggacgctgggcccagagaaaggaggcagaaggaaagccatcttacctgaagagacggtgaccattgtcccttggccccagatatcaaaaggtcgaccgttacttttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacccgttacttttaacgtcctgagcgggctggcaaggc

SEQ ID NO: 2159 - DNA, 495 bp, Artificial Sequence
  source: /note="Description of Artificial Sequence: Synthetic polynucleotide"
gcctccctcgcgccatcagcgttacttagcaacctccaggacagaggacgctgggcccagagaaaggaggcagaaggaaagccatcttacctgaagagacggtgaccattgtcccttggccccagatatcaaaaggtcgaccgttacttagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggaccgttacttagcaacctctgagcgggctggcaaggc

SEQ ID NO: 2160 - DNA, 495 bp, Artificial Sequence
  source: /note="Description of Artificial Sequence: Synthetic polynucleotide"
gcctccctcgcgccatcagcgttacttttctcgagccaggacagaggacgctgggcccagagaaaggaggcagaaggaaagccatcttacctgaagagacggtgaccattgtcccttggccccagatatcaaaaggtcgaccgttacttttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttcgttacttttctcgagctgagcgggctggcaaggc

SEQ ID NO: 2161 - DNA, 495 bp, Artificial Sequence
  source: /note="Description of Artificial Sequence: Synthetic polynucleotide"
gcctccctcgcgccatcagcgttacttactctacgccaggacagaggacgctgggcccagagaaaggaggcagaaggaaagccatcttacctgaagagacggtgaccattgtcccttggccccagatatcaaaaggtcgaccgttacttactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggaccgttacttactctacgctgagcgggctggcaaggc

SEQ ID NO: 2162 - DNA, 495 bp, Artificial Sequence
  source: /note="Description of Artificial Sequence: Synthetic polynucleotide"
gcctccctcgcgccatcagcgttactttaccggaaccaggacagaggacgctgggcccagagaaaggaggcagaaggaaagccatcttacctgaagagacggtgaccattgtcccttggccccagatatcaaaaggtcgaccgttactttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacccgttactttaccggaactgagcgggctggcaaggc

SEQ ID NO: 2163 - DNA, 495 bp, Artificial Sequence
  source: /note="Description of Artificial Sequence: Synthetic polynucleotide"
gcctccctcgcgccatcagcgttacttcgaattgcccaggacagaggacgctgggcccagagaaaggaggcagaaggaaagccatcttacctgaagagacggtgaccattgtcccttggccccagatatcaaaaggtcgaccgttacttcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaaccgttacttcgaattgcctgagcgggctggcaaggc

SEQ ID NO: 2164 - DNA, 495 bp, Artificial Sequence
  source: /note="Description of Artificial Sequence: Synthetic polynucleotide"
gcctccctcgcgccatcagcgttacttttcgctcaccaggacagaggacgctgggcccagagaaaggaggcagaaggaaagccatcttacctgaagagacggtgaccattgtcccttggccccagatatcaaaaggtcgaccgttacttttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacacgttacttttcgctcactgagcgggctggcaaggc

SEQ ID NO: 2165 - DNA, 495 bp, Artificial Sequence
  source: /note="Description of Artificial Sequence: Synthetic polynucleotide"
gcctccctcgcgccatcagcgttacttgacgttaaccaggacagaggacgctgggcccagagaaaggaggcagaaggaaagccatcttacctgaagagacggtgaccattgtcccttggccccagatatcaaaaggtcgaccgttacttgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgcgttacttgacgttaactgagcgggctggcaaggc

SEQ ID NO: 2166 - DNA, 495 bp, Artificial Sequence
  source: /note="Description of Artificial Sequence: Synthetic polynucleotide"
gcctccctcgcgccatcagcgttacttcgtagagtccaggacagaggacgctgggcccagagaaaggaggcagaaggaaagccatcttacctgaagagacggtgaccattgtcccttggccccagatatcaaaaggtcgaccgttacttcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgccgttacttcgtagagtctgagcgggctggcaaggc

SEQ ID NO: 2167 - DNA, 495 bp, Artificial Sequence
  source: /note="Description of Artificial Sequence: Synthetic polynucleotide"
gcctccctcgcgccatcagcgttacttttccggtaccaggacagaggacgctgggcccagagaaaggaggcagaaggaaagccatcttacctgaagagacggtgaccattgtcccttggccccagatatcaaaaggtcgaccgttacttttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgccgttacttttccggtactgagcgggctggcaaggc

SEQ ID NO: 2168 - DNA, 495 bp, Artificial Sequence
  source: /note="Description of Artificial Sequence: Synthetic polynucleotide"
gcctccctcgcgccatcagcgttacttgcaattcgccaggacagaggacgctgggcccagagaaaggaggcagaaggaaagccatcttacctgaagagacggtgaccattgtcccttggccccagatatcaaaaggtcgaccgttacttgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacaccgttacttgcaattcgctgagcgggctggcaaggc

SEQ ID NO: 2169 - DNA, 495 bp, Artificial Sequence
  source: /note="Description of Artificial Sequence: Synthetic polynucleotide"
gcctccctcgcgccatcagcgttactttgagcgaaccaggacagaggacgctgggcccagagaaaggaggcagaaggaaagccatcttacctgaagagacggtgaccattgtcccttggccccagatatcaaaaggtcgaccgttactttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgccgttactttgagcgaactgagcgggctggcaaggc

SEQ ID NO: 2170 - DNA, 495 bp, Artificial Sequence
  source: /note="Description of Artificial Sequence: Synthetic polynucleotide"
gcctccctcgcgccatcagcgttactttactaagcccaggacagaggacgctgggcccagagaaaggaggcagaaggaaagccatcttacctgaagagacggtgaccattgtcccttggccccagatatcaaaaggtcgaccgttactttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccccgttactttactaagcctgagcgggctggcaaggc

SEQ ID NO: 2171 - DNA, 495 bp, Artificial Sequence
  source: /note="Description of Artificial Sequence: Synthetic polynucleotide"
gcctccctcgcgccatcagcgttactttggcgtatccaggacagaggacgctgggcccagagaaaggaggcagaaggaaagccatcttacctgaagagacggtgaccattgtcccttggccccagatatcaaaaggtcgaccgttactttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtcgttactttggcgtatctgagcgggctggcaaggc

SEQ ID NO: 2172 - DNA, 495 bp, Artificial Sequence
  source: /note="Description of Artificial Sequence: Synthetic polynucleotide"
gcctccctcgcgccatcagcgttacttgataaccaccaggacagaggacgctgggcccagagaaaggaggcagaaggaaagccatcttacctgaagagacggtgaccattgtcccttggccccagatatcaaaaggtcgaccgttacttgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgcgttacttgataaccactgagcgggctggcaaggc

SEQ ID NO: 2173 - DNA, 495 bp, Artificial Sequence
  source: /note="Description of Artificial Sequence: Synthetic polynucleotide"
gcctccctcgcgccatcagcgttacttctagtgaaccaggacagaggacgctgggcccagagaaaggaggcagaaggaaagccatcttacctgaagagacggtgaccattgtcccttggccccagatatcaaaaggtcgaccgttacttctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagcgttacttctagtgaactgagcgggctggcaaggc

SEQ ID NO: 2174 - DNA, 495 bp, Artificial Sequence
  source: /note="Description of Artificial Sequence: Synthetic polynucleotide"
gcctccctcgcgccatcagcgttacttacgttcacccaggacagaggacgctgggcccagagaaaggaggcagaaggaaagccatcttacctgaagagacggtgaccattgtcccttggccccagatatcaaaaggtcgaccgttacttacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtcgttacttacgttcacctgagcgggctggcaaggc

SEQ ID NO: 2175 - DNA, 448 bp, Artificial Sequence
  source: /note="Description of Artificial Sequence: Synthetic polynucleotide"
gcctccctcgcgccatcagcgttacttattacgctccaggacagaggacgctgggcccagagaaaggaggcagaaggaaagccatcttacctgaagagacggtgaccattgtcccttggccccagatatcaaaaggtcgaccgttacttattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcacgttacttattacgctctgagcgggctggcaaggc

SEQ ID NO: 2176 - DNA, 495 bp, Artificial Sequence
  source: /note="Description of Artificial Sequence: Synthetic polynucleotide"
gcctccctcgcgccatcagcgttacttcattgagtccaggacagaggacgctgggcccagagaaaggaggcagaaggaaagccatcttacctgaagagacggtgaccattgtcccttggccccagatatcaaaaggtcgaccgttacttcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacccgttacttcattgagtctgagcgggctggcaaggc

SEQ ID NO: 2177 - DNA, 495 bp, Artificial Sequence
  source: /note="Description of Artificial Sequence: Synthetic polynucleotide"
gcctccctcgcgccatcagtaggagaccttggttacagaaatgcagcaaaacccttcagagttaaagcaggagagaggttgtgaggactcacctgaggagacggtgaccagggttccctggccccagtagtcaaagtcgactaggagaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctaggagaccttggttactgagcgggctggcaaggc

SEQ ID NO: 2178 - DNA, 495 bp, Artificial Sequence
  source: /note="Description of Artificial Sequence: Synthetic polynucleotide"
gcctccctcgcgccatcagtaggagacacctcttgcagaaatgcagcaaaacccttcagagttaaagcaggagagaggttgtgaggactcacctgaggagacggtgaccagggttccctggccccagtagtcaaagtcgactaggagacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctaggagacacctcttgctgagcgggctggcaaggc

SEQ ID NO: 2179 - DNA, 495 bp, Artificial Sequence
  source: /note="Description of Artificial Sequence: Synthetic polynucleotide"
gcctccctcgcgccatcagtaggagacctgattctcagaaatgcagcaaaacccttcagagttaaagcaggagagaggttgtgaggactcacctgaggagacggtgaccagggttccctggccccagtagtcaaagtcgactaggagacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacctaggagacctgattctctgagcgggctggcaaggc

SEQ ID NO: 2180 - DNA, 495 bp, Artificial Sequence
  source: /note="Description of Artificial Sequence: Synthetic polynucleotide"
gcctccctcgcgccatcagtaggagacagtaccgacagaaatgcagcaaaacccttcagagttaaagcaggagagaggttgtgaggactcacctgaggagacggtgaccagggttccctggccccagtagtcaaagtcgactaggagacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacctaggagacagtaccgactgagcgggctggcaaggc

SEQ ID NO: 2181 - DNA, 495 bp, Artificial Sequence
  source: /note="Description of Artificial Sequence: Synthetic polynucleotide"
gcctccctcgcgccatcagtaggagacatccatggcagaaatgcagcaaaacccttcagagttaaagcaggagagaggttgtgaggactcacctgaggagacggtgaccagggttccctggccccagtagtcaaagtcgactaggagacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcctaggagacatccatggctgagcgggctggcaaggc

SEQ ID NO: 2182 - DNA, 495 bp, Artificial Sequence
  source: /note="Description of Artificial Sequence: Synthetic polynucleotide"
gcctccctcgcgccatcagtaggagacgtagcagtcagaaatgcagcaaaacccttcagagttaaagcaggagagaggttgtgaggactcacctgaggagacggtgaccagggttccctggccccagtagtcaaagtcgactaggagacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatctaggagacgtagcagtctgagcgggctggcaaggc

SEQ ID NO: 2183 - DNA, 495 bp, Artificial Sequence
  source: /note="Description of Artificial Sequence: Synthetic polynucleotide"
gcctccctcgcgccatcagtaggagacatcttcgtcagaaatgcagcaaaacccttcagagttaaagcaggagagaggttgtgaggactcacctgaggagacggtgaccagggttccctggccccagtagtcaaagtcgactaggagacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacctaggagacatcttcgtctgagcgggctggcaaggc

SEQ ID NO: 2184 - DNA, 495 bp, Artificial Sequence
  source: /note="Description of Artificial Sequence: Synthetic polynucleotide"
gcctccctcgcgccatcagtaggagactccacagtcagaaatgcagcaaaacccttcagagttaaagcaggagagaggttgtgaggactcacctgaggagacggtgaccagggttccctggccccagtagtcaaagtcgactaggagactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacctaggagactccacagtctgagcgggctggcaaggc

SEQ ID NO: 2185 - DNA, 495 bp, Artificial Sequence
  source: /note="Description of Artificial Sequence: Synthetic polynucleotide"
gcctccctcgcgccatcagtaggagacagctagtgcagaaatgcagcaaaacccttcagagttaaagcaggagagaggttgtgaggactcacctgaggagacggtgaccagggttccctggccccagtagtcaaagtcgactaggagacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacctaggagacagctagtgctgagcgggctggcaaggc

SEQ ID NO: 2186 - DNA, 495 bp, Artificial Sequence
  source: /note="Description of Artificial Sequence: Synthetic polynucleotide"
gcctccctcgcgccatcagtaggagactaaccaagcagaaatgcagcaaaacccttcagagttaaagcaggagagaggttgtgaggactcacctgaggagacggtgaccagggttccctggccccagtagtcaaagtcgactaggagactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacctaggagactaaccaagctgagcgggctggcaaggc

SEQ ID NO: 2187 - DNA, 495 bp, Artificial Sequence
  source: /note="Description of Artificial Sequence: Synthetic polynucleotide"
gcctccctcgcgccatcagtaggagaccaagaggtcagaaatgcagcaaaacccttcagagttaaagcaggagagaggttgtgaggactcacctgaggagacggtgaccagggttccctggccccagtagtcaaagtcgactaggagaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcctaggagaccaagaggtctgagcgggctggcaaggc

SEQ ID NO: 2188 - DNA, 495 bp, Artificial Sequence
  source: /note="Description of Artificial Sequence: Synthetic polynucleotide"
gcctccctcgcgccatcagtaggagacagttgacccagaaatgcagcaaaacccttcagagttaaagcaggagagaggttgtgaggactcacctgaggagacggtgaccagggttccctggccccagtagtcaaagtcgactaggagacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaataggagacagttgaccctgagcgggctggcaaggc

SEQ ID NO: 2189 - DNA, 495 bp, Artificial Sequence
  source: /note="Description of Artificial Sequence: Synthetic polynucleotide"
gcctccctcgcgccatcagtaggagaccagcatatcagaaatgcagcaaaacccttcagagttaaagcaggagagaggttgtgaggactcacctgaggagacggtgaccagggttccctggccccagtagtcaaagtcgactaggagaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaataggagaccagcatatctgagcgggctggcaaggc

SEQ ID NO: 2190 - DNA, 495 bp, Artificial Sequence
  source: /note="Description of Artificial Sequence: Synthetic polynucleotide"
gcctccctcgcgccatcagtaggagacgcaggattcagaaatgcagcaaaacccttcagagttaaagcaggagagaggttgtgaggactcacctgaggagacggtgaccagggttccctggccccagtagtcaaagtcgactaggagacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataataggagacgcaggattctgagcgggctggcaaggc

SEQ ID NO: 2191 - DNA, 495 bp, Artificial Sequence
  source: /note="Description of Artificial Sequence: Synthetic polynucleotide"
gcctccctcgcgccatcagtaggagacgtccattccagaaatgcagcaaaacccttcagagttaaagcaggagagaggttgtgaggactcacctgaggagacggtgaccagggttccctggccccagtagtcaaagtcgactaggagacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacctaggagacgtccattcctgagcgggctggcaaggc

SEQ ID NO: 2192 - DNA, 495 bp, Artificial Sequence
  source: /note="Description of Artificial Sequence: Synthetic polynucleotide"
gcctccctcgcgccatcagtaggagacgcataactcagaaatgcagcaaaacccttcagagttaaagcaggagagaggttgtgaggactcacctgaggagacggtgaccagggttccctggccccagtagtcaaagtcgactaggagacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggactaggagacgcataactctgagcgggctggcaaggc

SEQ ID NO: 2193 - DNA, 495 bp, Artificial Sequence
  source: /note="Description of Artificial Sequence: Synthetic polynucleotide"
gcctccctcgcgccatcagtaggagacatatgctgcagaaatgcagcaaaacccttcagagttaaagcaggagagaggttgtgaggactcacctgaggagacggtgaccagggttccctggccccagtagtcaaagtcgactaggagacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacctaggagacatatgctgctgagcgggctggcaaggc

SEQ ID NO: 2194 - DNA, 495 bp, Artificial Sequence
  source: /note="Description of Artificial Sequence: Synthetic polynucleotide"
gcctccctcgcgccatcagtaggagacaatcctgccagaaatgcagcaaaacccttcagagttaaagcaggagagaggttgtgaggactcacctgaggagacggtgaccagggttccctggccccagtagtcaaagtcgactaggagacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgctaggagacaatcctgcctgagcgggctggcaaggc

SEQ ID NO: 2195 - DNA, 495 bp, Artificial Sequence
  source: /note="Description of Artificial Sequence: Synthetic polynucleotide"
gcctccctcgcgccatcagtaggagactgagacctcagaaatgcagcaaaacccttcagagttaaagcaggagagaggttgtgaggactcacctgaggagacggtgaccagggttccctggccccagtagtcaaagtcgactaggagactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgtaggagactgagacctctgagcgggctggcaaggc

SEQ ID NO: 2196 - DNA, 495 bp, Artificial Sequence
  source: /note="Description of Artificial Sequence: Synthetic polynucleotide"
gcctccctcgcgccatcagtaggagacgaatggaccagaaatgcagcaaaacccttcagagttaaagcaggagagaggttgtgaggactcacctgaggagacggtgaccagggttccctggccccagtagtcaaagtcgactaggagacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacctaggagacgaatggacctgagcgggctggcaaggc

SEQ ID NO: 2197 - DNA, 495 bp, Artificial Sequence
  source: /note="Description of Artificial Sequence: Synthetic polynucleotide"
gcctccctcgcgccatcagtaggagaccacatggacagaaatgcagcaaaacccttcagagttaaagcaggagagaggttgtgaggactcacctgaggagacggtgaccagggttccctggccccagtagtcaaagtcgactaggagaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacctaggagaccacatggactgagcgggctggcaaggc

SEQ ID NO: 2198 - DNA, 495 bp, Artificial Sequence
  source: /note="Description of Artificial Sequence: Synthetic polynucleotide"
gcctccctcgcgccatcagtaggagacttgaccatcagaaatgcagcaaaacccttcagagttaaagcaggagagaggttgtgaggactcacctgaggagacggtgaccagggttccctggccccagtagtcaaagtcgactaggagacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacctaggagacttgaccatctgagcgggctggcaaggc

SEQ ID NO: 2199 - DNA, 495 bp, Artificial Sequence
  source: /note="Description of Artificial Sequence: Synthetic polynucleotide"
gcctccctcgcgccatcagtaggagacaagccatccagaaatgcagcaaaacccttcagagttaaagcaggagagaggttgtgaggactcacctgaggagacggtgaccagggttccctggccccagtagtcaaagtcgactaggagacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacctaggagacaagccatcctgagcgggctggcaaggc

SEQ ID NO: 2200 - DNA, 495 bp, Artificial Sequence
  source: /note="Description of Artificial Sequence: Synthetic polynucleotide"
gcctccctcgcgccatcagtaggagactccatgtgcagaaatgcagcaaaacccttcagagttaaagcaggagagaggttgtgaggactcacctgaggagacggtgaccagggttccctggccccagtagtcaaagtcgactaggagactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagactccatgtgctgagcgggctggcaaggc

SEQ ID NO: 2201 - DNA, 495 bp, Artificial Sequence
  source: /note="Description of Artificial Sequence: Synthetic polynucleotide"
gcctccctcgcgccatcagtaggagaccaagtcaccagaaatgcagcaaaacccttcagagttaaagcaggagagaggttgtgaggactcacctgaggagacggtgaccagggttccctggccccagtagtcaaagtcgactaggagaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagaccaagtcacctgagcgggctggcaaggc

SEQ ID NO: 2202 - DNA, 495 bp, Artificial Sequence
  source: /note="Description of Artificial Sequence: Synthetic polynucleotide"
gcctccctcgcgccatcagtaggagacctgcaatccagaaatgcagcaaaacccttcagagttaaagcaggagagaggttgtgaggactcacctgaggagacggtgaccagggttccctggccccagtagtcaaagtcgactaggagacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacctaggagacctgcaatcctgagcgggctggcaaggc

SEQ ID NO: 2203 - DNA, 495 bp, Artificial Sequence
  source: /note="Description of Artificial Sequence: Synthetic polynucleotide"
gcctccctcgcgccatcagtaggagacatcgacgacagaaatgcagcaaaacccttcagagttaaagcaggagagaggttgtgaggactcacctgaggagacggtgaccagggttccctggccccagtagtcaaagtcgactaggagacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacctaggagacatcgacgactgagcgggctggcaaggc

SEQ ID NO: 2204 - DNA, 495 bp, Artificial Sequence
  source: /note="Description of Artificial Sequence: Synthetic polynucleotide"
gcctccctcgcgccatcagtaggagacacagactgcagaaatgcagcaaaacccttcagagttaaagcaggagagaggttgtgaggactcacctgaggagacggtgaccagggttccctggccccagtagtcaaagtcgactaggagacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaataggagacacagactgctgagcgggctggcaaggc

SEQ ID NO: 2205 - DNA, 495 bp, Artificial Sequence
  source: /note="Description of Artificial Sequence: Synthetic polynucleotide"
gcctccctcgcgccatcagtaggagacccttatagcagaaatgcagcaaaacccttcagagttaaagcaggagagaggttgtgaggactcacctgaggagacggtgaccagggttccctggccccagtagtcaaagtcgactaggagacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggactaggagacccttatagctgagcgggctggcaaggc

SEQ ID NO: 2206 - DNA, 495 bp, Artificial Sequence
  source: /note="Description of Artificial Sequence: Synthetic polynucleotide"
gcctccctcgcgccatcagtaggagactacgcgttcagaaatgcagcaaaacccttcagagttaaagcaggagagaggttgtgaggactcacctgaggagacggtgaccagggttccctggccccagtagtcaaagtcgactaggagactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacctaggagactacgcgttctgagcgggctggcaaggc

SEQ ID NO: 2207 - DNA, 495 bp, Artificial Sequence
  source: /note="Description of Artificial Sequence: Synthetic polynucleotide"
gcctccctcgcgccatcagtaggagacctataaggcagaaatgcagcaaaacccttcagagttaaagcaggagagaggttgtgaggactcacctgaggagacggtgaccagggttccctggccccagtagtcaaagtcgactaggagacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgtaggagacctataaggctgagcgggctggcaaggc

SEQ ID NO: 2208 - DNA, 495 bp, Artificial Sequence
  source: /note="Description of Artificial Sequence: Synthetic polynucleotide"
gcctccctcgcgccatcagtaggagactcttagtccagaaatgcagcaaaacccttcagagttaaagcaggagagaggttgtgaggactcacctgaggagacggtgaccagggttccctggccccagtagtcaaagtcgactaggagactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagactcttagtcctgagcgggctggcaaggc

SEQ ID NO: 2209 - DNA, 495 bp, Artificial Sequence
  source: /note="Description of Artificial Sequence: Synthetic polynucleotide"
gcctccctcgcgccatcagtaggagactgtctgcacagaaatgcagcaaaacccttcagagttaaagcaggagagaggttgtgaggactcacctgaggagacggtgaccagggttccctggccccagtagtcaaagtcgactaggagactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacctaggagactgtctgcactgagcgggctggcaaggc

SEQ ID NO: 2210 - DNA, 495 bp, Artificial Sequence
  source: /note="Description of Artificial Sequence: Synthetic polynucleotide"
gcctccctcgcgccatcagtaggagacgccattaacagaaatgcagcaaaacccttcagagttaaagcaggagagaggttgtgaggactcacctgaggagacggtgaccagggttccctggccccagtagtcaaagtcgactaggagacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagacgccattaactgagcgggctggcaaggc

SEQ ID NO: 2211 - DNA, 495 bp, Artificial Sequence
  source: /note="Description of Artificial Sequence: Synthetic polynucleotide"
gcctccctcgcgccatcagtaggagacgactaagacagaaatgcagcaaaacccttcagagttaaagcaggagagaggttgtgaggactcacctgaggagacggtgaccagggttccctggccccagtagtcaaagtcgactaggagacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgtaggagacgactaagactgagcgggctggcaaggc

SEQ ID NO: 2212 - DNA, 495 bp, Artificial Sequence
  source: /note="Description of Artificial Sequence: Synthetic polynucleotide"
gcctccctcgcgccatcagtaggagacaggttgctcagaaatgcagcaaaacccttcagagttaaagcaggagagaggttgtgaggactcacctgaggagacggtgaccagggttccctggccccagtagtcaaagtcgactaggagacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgtaggagacaggttgctctgagcgggctggcaaggc

SEQ ID NO: 2213 - DNA, 495 bp, Artificial Sequence
  source: /note="Description of Artificial Sequence: Synthetic polynucleotide"
gcctccctcgcgccatcagtaggagacctcgagaacagaaatgcagcaaaacccttcagagttaaagcaggagagaggttgtgaggactcacctgaggagacggtgaccagggttccctggccccagtagtcaaagtcgactaggagacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacctaggagacctcgagaactgagcgggctggcaaggc

SEQ ID NO: 2214 - DNA, 495 bp, Artificial Sequence
  source: /note="Description of Artificial Sequence: Synthetic polynucleotide"
gcctccctcgcgccatcagtaggagacttaatggccagaaatgcagcaaaacccttcagagttaaagcaggagagaggttgtgaggactcacctgaggagacggtgaccagggttccctggccccagtagtcaaagtcgactaggagacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacctaggagacttaatggcctgagcgggctggcaaggc

SEQ ID NO: 2215 - DNA, 495 bp, Artificial Sequence
  source: /note="Description of Artificial Sequence: Synthetic polynucleotide"
gcctccctcgcgccatcagtaggagactgcagacacagaaatgcagcaaaacccttcagagttaaagcaggagagaggttgtgaggactcacctgaggagacggtgaccagggttccctggccccagtagtcaaagtcgactaggagactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaataggagactgcagacactgagcgggctggcaaggc

SEQ ID NO: 2216 - DNA, 495 bp, Artificial Sequence
  source: /note="Description of Artificial Sequence: Synthetic polynucleotide"
gcctccctcgcgccatcagtaggagactcactgagcagaaatgcagcaaaacccttcagagttaaagcaggagagaggttgtgaggactcacctgaggagacggtgaccagggttccctggccccagtagtcaaagtcgactaggagactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgttaggagactcactgagctgagcgggctggcaaggc

SEQ ID NO: 2217 - DNA, 495 bp, Artificial Sequence
  source: /note="Description of Artificial Sequence: Synthetic polynucleotide"
gcctccctcgcgccatcagtaggagacgagtacgtcagaaatgcagcaaaacccttcagagttaaagcaggagagaggttgtgaggactcacctgaggagacggtgaccagggttccctggccccagtagtcaaagtcgactaggagacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccactaggagacgagtacgtctgagcgggctggcaaggc

SEQ ID NO: 2218 - DNA, 495 bp, Artificial Sequence
  source: /note="Description of Artificial Sequence: Synthetic polynucleotide"
gcctccctcgcgccatcagtaggagacatacgccacagaaatgcagcaaaacccttcagagttaaagcaggagagaggttgtgaggactcacctgaggagacggtgaccagggttccctggccccagtagtcaaagtcgactaggagacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggactaggagacatacgccactgagcgggctggcaaggc

SEQ ID NO: 2219 - DNA, 495 bp, Artificial Sequence
  source: /note="Description of Artificial Sequence: Synthetic polynucleotide"
gcctccctcgcgccatcagtaggagactcgcatcacagaaatgcagcaaaacccttcagagttaaagcaggagagaggttgtgaggactcacctgaggagacggtgaccagggttccctggccccagtagtcaaagtcgactaggagactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggactaggagactcgcatcactgagcgggctggcaaggc

SEQ ID NO: 2220 - DNA, 495 bp, Artificial Sequence
  source: /note="Description of Artificial Sequence: Synthetic polynucleotide"
gcctccctcgcgccatcagtaggagaccgcttaatcagaaatgcagcaaaacccttcagagttaaagcaggagagaggttgtgaggactcacctgaggagacggtgaccagggttccctggccccagtagtcaaagtcgactaggagaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggactaggagaccgcttaatctgagcgggctggcaaggc

SEQ ID NO: 2221 - DNA, 495 bp, Artificial Sequence
  source: /note="Description of Artificial Sequence: Synthetic polynucleotide"
gcctccctcgcgccatcagtaggagactggttatccagaaatgcagcaaaacccttcagagttaaagcaggagagaggttgtgaggactcacctgaggagacggtgaccagggttccctggccccagtagtcaaagtcgactaggagactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgttaggagactggttatcctgagcgggctggcaaggc

SEQ ID NO: 2222 - DNA, 495 bp, Artificial Sequence
  source: /note="Description of Artificial Sequence: Synthetic polynucleotide"
gcctccctcgcgccatcagtaggagacggattgctcagaaatgcagcaaaacccttcagagttaaagcaggagagaggttgtgaggactcacctgaggagacggtgaccagggttccctggccccagtagtcaaagtcgactaggagacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggactaggagacggattgctctgagcgggctggcaaggc

SEQ ID NO: 2223 - DNA, 495 bp, Artificial Sequence
  source: /note="Description of Artificial Sequence: Synthetic polynucleotide"
gcctccctcgcgccatcagtaggagacctcagtgacagaaatgcagcaaaacccttcagagttaaagcaggagagaggttgtgaggactcacctgaggagacggtgaccagggttccctggccccagtagtcaaagtcgactaggagacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgttaggagacctcagtgactgagcgggctggcaaggc

SEQ ID NO: 2224 - DNA, 495 bp, Artificial Sequence
  source: /note="Description of Artificial Sequence: Synthetic polynucleotide"
gcctccctcgcgccatcagtaggagacacgtactccagaaatgcagcaaaacccttcagagttaaagcaggagagaggttgtgaggactcacctgaggagacggtgaccagggttccctggccccagtagtcaaagtcgactaggagacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggactaggagacacgtactcctgagcgggctggcaaggc

SEQ ID NO: 2225 - DNA, 495 bp, Artificial Sequence
  source: /note="Description of Artificial Sequence: Synthetic polynucleotide"
gcctccctcgcgccatcagtaggagactgatgcgacagaaatgcagcaaaacccttcagagttaaagcaggagagaggttgtgaggactcacctgaggagacggtgaccagggttccctggccccagtagtcaaagtcgactaggagactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccctaggagactgatgcgactgagcgggctggcaaggc

SEQ ID NO: 2226 - DNA, 495 bp, Artificial Sequence
  source: /note="Description of Artificial Sequence: Synthetic polynucleotide"
gcctccctcgcgccatcagtaggagacattaagcgcagaaatgcagcaaaacccttcagagttaaagcaggagagaggttgtgaggactcacctgaggagacggtgaccagggttccctggccccagtagtcaaagtcgactaggagacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcctaggagacattaagcgctgagcgggctggcaaggc

SEQ ID NO: 2227 - DNA, 495 bp, Artificial Sequence
  source: /note="Description of Artificial Sequence: Synthetic polynucleotide"
gcctccctcgcgccatcagtaggagacagcaatcccagaaatgcagcaaaacccttcagagttaaagcaggagagaggttgtgaggactcacctgaggagacggtgaccagggttccctggccccagtagtcaaagtcgactaggagacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcctaggagacagcaatccctgagcgggctggcaaggc

SEQ ID NO: 2228 - DNA, 495 bp, Artificial Sequence
  source: /note="Description of Artificial Sequence: Synthetic polynucleotide"
gcctccctcgcgccatcagtaggagacgcttagtacagaaatgcagcaaaacccttcagagttaaagcaggagagaggttgtgaggactcacctgaggagacggtgaccagggttccctggccccagtagtcaaagtcgactaggagacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgataggagacgcttagtactgagcgggctggcaaggc

SEQ ID NO: 2229 - DNA, 495 bp, Artificial Sequence
  source: /note="Description of Artificial Sequence: Synthetic polynucleotide"
gcctccctcgcgccatcagtaggagactgaccttgcagaaatgcagcaaaacccttcagagttaaagcaggagagaggttgtgaggactcacctgaggagacggtgaccagggttccctggccccagtagtcaaagtcgactaggagactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacctaggagactgaccttgctgagcgggctggcaaggc

SEQ ID NO: 2230 - DNA, 495 bp, Artificial Sequence
  source: /note="Description of Artificial Sequence: Synthetic polynucleotide"
gcctccctcgcgccatcagtaggagaccaaggtcacagaaatgcagcaaaacccttcagagttaaagcaggagagaggttgtgaggactcacctgaggagacggtgaccagggttccctggccccagtagtcaaagtcgactaggagaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacctaggagaccaaggtcactgagcgggctggcaaggc

SEQ ID NO: 2231 - DNA, 495 bp, Artificial Sequence
  source: /note="Description of Artificial Sequence: Synthetic polynucleotide"
gcctccctcgcgccatcagtaggagaccactgtaccagaaatgcagcaaaacccttcagagttaaagcaggagagaggttgtgaggactcacctgaggagacggtgaccagggttccctggccccagtagtcaaagtcgactaggagaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctaggagaccactgtacctgagcgggctggcaaggc

SEQ ID NO: 2232 - DNA, 495 bp, Artificial Sequence
  source: /note="Description of Artificial Sequence: Synthetic polynucleotide"
gcctccctcgcgccatcagtaggagacgatgatcccagaaatgcagcaaaacccttcagagttaaagcaggagagaggttgtgaggactcacctgaggagacggtgaccagggttccctggccccagtagtcaaagtcgactaggagacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggtaggagacgatgatccctgagcgggctggcaaggc

SEQ ID NO: 2233 - DNA, 495 bp, Artificial Sequence
  source: /note="Description of Artificial Sequence: Synthetic polynucleotide"
gcctccctcgcgccatcagtaggagaccgccaatacagaaatgcagcaaaacccttcagagttaaagcaggagagaggttgtgaggactcacctgaggagacggtgaccagggttccctggccccagtagtcaaagtcgactaggagaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggtaggagaccgccaatactgagcgggctggcaaggc

SEQ ID NO: 2234 - DNA, 495 bp, Artificial Sequence
  source: /note="Description of Artificial Sequence: Synthetic polynucleotide"
gcctccctcgcgccatcagtaggagactcaagcctcagaaatgcagcaaaacccttcagagttaaagcaggagagaggttgtgaggactcacctgaggagacggtgaccagggttccctggccccagtagtcaaagtcgactaggagactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacataggagactcaagcctctgagcgggctggcaaggc

SEQ ID NO: 2235 - DNA, 495 bp, Artificial Sequence
  source: /note="Description of Artificial Sequence: Synthetic polynucleotide"
gcctccctcgcgccatcagtaggagacacgtgtgtcagaaatgcagcaaaacccttcagagttaaagcaggagagaggttgtgaggactcacctgaggagacggtgaccagggttccctggccccagtagtcaaagtcgactaggagacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagtaggagacacgtgtgtctgagcgggctggcaaggc

SEQ ID NO: 2236 - DNA, 495 bp, Artificial Sequence
  source: /note="Description of Artificial Sequence: Synthetic polynucleotide"
gcctccctcgcgccatcagtaggagactccgtctacagaaatgcagcaaaacccttcagagttaaagcaggagagaggttgtgaggactcacctgaggagacggtgaccagggttccctggccccagtagtcaaagtcgactaggagactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagtaggagactccgtctactgagcgggctggcaaggc

SEQ ID NO: 2237 - DNA, 495 bp, Artificial Sequence
  source: /note="Description of Artificial Sequence: Synthetic polynucleotide"
gcctccctcgcgccatcagtaggagacaagagctgcagaaatgcagcaaaacccttcagagttaaagcaggagagaggttgtgaggactcacctgaggagacggtgaccagggttccctggccccagtagtcaaagtcgactaggagacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgtaggagacaagagctgctgagcgggctggcaaggc

SEQ ID NO: 2238 - DNA, 495 bp, Artificial Sequence
  source: /note="Description of Artificial Sequence: Synthetic polynucleotide"
gcctccctcgcgccatcagtaggagactatcgctccagaaatgcagcaaaacccttcagagttaaagcaggagagaggttgtgaggactcacctgaggagacggtgaccagggttccctggccccagtagtcaaagtcgactaggagactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagtaggagactatcgctcctgagcgggctggcaaggc

SEQ ID NO: 2239 - DNA, 495 bp, Artificial Sequence
  source: /note="Description of Artificial Sequence: Synthetic polynucleotide"
gcctccctcgcgccatcagtaggagactcagatgccagaaatgcagcaaaacccttcagagttaaagcaggagagaggttgtgaggactcacctgaggagacggtgaccagggttccctggccccagtagtcaaagtcgactaggagactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccctaggagactcagatgcctgagcgggctggcaaggc

SEQ ID NO: 2240 - DNA, 495 bp, Artificial Sequence
  source: /note="Description of Artificial Sequence: Synthetic polynucleotide"
gcctccctcgcgccatcagtaggagacgtgtagcacagaaatgcagcaaaacccttcagagttaaagcaggagagaggttgtgaggactcacctgaggagacggtgaccagggttccctggccccagtagtcaaagtcgactaggagacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgtaggagacgtgtagcactgagcgggctggcaaggc

SEQ ID NO: 2241 - DNA, 495 bp, Artificial Sequence
  source: /note="Description of Artificial Sequence: Synthetic polynucleotide"
gcctccctcgcgccatcagtaggagactggcagttcagaaatgcagcaaaacccttcagagttaaagcaggagagaggttgtgaggactcacctgaggagacggtgaccagggttccctggccccagtagtcaaagtcgactaggagactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgtaggagactggcagttctgagcgggctggcaaggc

SEQ ID NO: 2242 - DNA, 495 bp, Artificial Sequence
  source: /note="Description of Artificial Sequence: Synthetic polynucleotide"
gcctccctcgcgccatcagtaggagaccagtccaacagaaatgcagcaaaacccttcagagttaaagcaggagagaggttgtgaggactcacctgaggagacggtgaccagggttccctggccccagtagtcaaagtcgactaggagaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcactaggagaccagtccaactgagcgggctggcaaggc

SEQ ID NO: 2243 - DNA, 495 bp, Artificial Sequence
  source: /note="Description of Artificial Sequence: Synthetic polynucleotide"
gcctccctcgcgccatcagtaggagacgtgtctaccagaaatgcagcaaaacccttcagagttaaagcaggagagaggttgtgaggactcacctgaggagacggtgaccagggttccctggccccagtagtcaaagtcgactaggagacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggtaggagacgtgtctacctgagcgggctggcaaggc

SEQ ID NO: 2244 - DNA, 495 bp, Artificial Sequence
  source: /note="Description of Artificial Sequence: Synthetic polynucleotide"
gcctccctcgcgccatcagtaggagacgtacagtgcagaaatgcagcaaaacccttcagagttaaagcaggagagaggttgtgaggactcacctgaggagacggtgaccagggttccctggccccagtagtcaaagtcgactaggagacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagtaggagacgtacagtgctgagcgggctggcaaggc

SEQ ID NO: 2245 - DNA, 495 bp, Artificial Sequence
  source: /note="Description of Artificial Sequence: Synthetic polynucleotide"
gcctccctcgcgccatcagtaggagacggatcatccagaaatgcagcaaaacccttcagagttaaagcaggagagaggttgtgaggactcacctgaggagacggtgaccagggttccctggccccagtagtcaaagtcgactaggagacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagtaggagacggatcatcctgagcgggctggcaaggc

SEQ ID NO: 2246 - DNA, 495 bp, Artificial Sequence
  source: /note="Description of Artificial Sequence: Synthetic polynucleotide"
gcctccctcgcgccatcagtaggagactattggcgcagaaatgcagcaaaacccttcagagttaaagcaggagagaggttgtgaggactcacctgaggagacggtgaccagggttccctggccccagtagtcaaagtcgactaggagactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcataggagactattggcgctgagcgggctggcaaggc

SEQ ID NO: 2247 - DNA, 495 bp, Artificial Sequence
  source: /note="Description of Artificial Sequence: Synthetic polynucleotide"
gcctccctcgcgccatcagtaggagacaggcttgacagaaatgcagcaaaacccttcagagttaaagcaggagagaggttgtgaggactcacctgaggagacggtgaccagggttccctggccccagtagtcaaagtcgactaggagacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcactaggagacaggcttgactgagcgggctggcaaggc

SEQ ID NO: 2248 - DNA, 495 bp, Artificial Sequence
  source: /note="Description of Artificial Sequence: Synthetic polynucleotide"
gcctccctcgcgccatcagtaggagacacacacgtcagaaatgcagcaaaacccttcagagttaaagcaggagagaggttgtgaggactcacctgaggagacggtgaccagggttccctggccccagtagtcaaagtcgactaggagacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcattaggagacacacacgtctgagcgggctggcaaggc

SEQ ID NO: 2249 - DNA, 495 bp, Artificial Sequence
  source: /note="Description of Artificial Sequence: Synthetic polynucleotide"
gcctccctcgcgccatcagtaggagactagacggacagaaatgcagcaaaacccttcagagttaaagcaggagagaggttgtgaggactcacctgaggagacggtgaccagggttccctggccccagtagtcaaagtcgactaggagactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgataggagactagacggactgagcgggctggcaaggc

SEQ ID NO: 2250 - DNA, 495 bp, Artificial Sequence
  source: /note="Description of Artificial Sequence: Synthetic polynucleotide"
gcctccctcgcgccatcagtaggagacgagcgatacagaaatgcagcaaaacccttcagagttaaagcaggagagaggttgtgaggactcacctgaggagacggtgaccagggttccctggccccagtagtcaaagtcgactaggagacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggtttttaggagacgagcgatactgagcgggctggcaaggc

SEQ ID NO: 2251 - DNA, 495 bp, Artificial Sequence
  source: /note="Description of Artificial Sequence: Synthetic polynucleotide"
gcctccctcgcgccatcagtaggagacgcatctgacagaaatgcagcaaaacccttcagagttaaagcaggagagaggttgtgaggactcacctgaggagacggtgaccagggttccctggccccagtagtcaaagtcgactaggagacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacataggagacgcatctgactgagcgggctggcaaggc

SEQ ID NO: 2252 - DNA, 495 bp, Artificial Sequence
  source: /note="Description of Artificial Sequence: Synthetic polynucleotide"
gcctccctcgcgccatcagtaggagactgctacaccagaaatgcagcaaaacccttcagagttaaagcaggagagaggttgtgaggactcacctgaggagacggtgaccagggttccctggccccagtagtcaaagtcgactaggagactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgtaggagactgctacacctgagcgggctggcaaggc

SEQ ID NO: 2253 - DNA, 495 bp, Artificial Sequence
  source: /note="Description of Artificial Sequence: Synthetic polynucleotide"
gcctccctcgcgccatcagtaggagacaactgccacagaaatgcagcaaaacccttcagagttaaagcaggagagaggttgtgaggactcacctgaggagacggtgaccagggttccctggccccagtagtcaaagtcgactaggagacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggactttaggagacaactgccactgagcgggctggcaaggc

SEQ ID NO: 2254 - DNA, 495 bp, Artificial Sequence
  source: /note="Description of Artificial Sequence: Synthetic polynucleotide"
gcctccctcgcgccatcagtaggagacttggactgcagaaatgcagcaaaacccttcagagttaaagcaggagagaggttgtgaggactcacctgaggagacggtgaccagggttccctggccccagtagtcaaagtcgactaggagacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggtaggagacttggactgctgagcgggctggcaaggc

SEQ ID NO: 2255 - DNA, 495 bp, Artificial Sequence
  source: /note="Description of Artificial Sequence: Synthetic polynucleotide"
gcctccctcgcgccatcagtaggagactcggtactcagaaatgcagcaaaacccttcagagttaaagcaggagagaggttgtgaggactcacctgaggagacggtgaccagggttccctggccccagtagtcaaagtcgactaggagactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgtaggagactcggtactctgagcgggctggcaaggc

SEQ ID NO: 2256 - DNA, 495 bp, Artificial Sequence
  source: /note="Description of Artificial Sequence: Synthetic polynucleotide"
gcctccctcgcgccatcagtaggagacccatggatcagaaatgcagcaaaacccttcagagttaaagcaggagagaggttgtgaggactcacctgaggagacggtgaccagggttccctggccccagtagtcaaagtcgactaggagacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatactaggagacccatggatctgagcgggctggcaaggc

SEQ ID NO: 2257 - DNA, 495 bp, Artificial Sequence
  source: /note="Description of Artificial Sequence: Synthetic polynucleotide"
gcctccctcgcgccatcagtaggagacacgaagatcagaaatgcagcaaaacccttcagagttaaagcaggagagaggttgtgaggactcacctgaggagacggtgaccagggttccctggccccagtagtcaaagtcgactaggagacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaataggagacacgaagatctgagcgggctggcaaggc

SEQ ID NO: 2258 - DNA, 495 bp, Artificial Sequence
  source: /note="Description of Artificial Sequence: Synthetic polynucleotide"
gcctccctcgcgccatcagtaggagacactgtggacagaaatgcagcaaaacccttcagagttaaagcaggagagaggttgtgaggactcacctgaggagacggtgaccagggttccctggccccagtagtcaaagtcgactaggagacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggactttaggagacactgtggactgagcgggctggcaaggc

SEQ ID NO: 2259 - DNA, 495 bp, Artificial Sequence
  source: /note="Description of Artificial Sequence: Synthetic polynucleotide"
gcctccctcgcgccatcagtaggagacggtgtcatcagaaatgcagcaaaacccttcagagttaaagcaggagagaggttgtgaggactcacctgaggagacggtgaccagggttccctggccccagtagtcaaagtcgactaggagacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactcttaggagacggtgtcatctgagcgggctggcaaggc

SEQ ID NO: 2260 - DNA, 495 bp, Artificial Sequence
  source: /note="Description of Artificial Sequence: Synthetic polynucleotide"
gcctccctcgcgccatcagtaggagactcgtgaagcagaaatgcagcaaaacccttcagagttaaagcaggagagaggttgtgaggactcacctgaggagacggtgaccagggttccctggccccagtagtcaaagtcgactaggagactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggtaggagactcgtgaagctgagcgggctggcaaggc

SEQ ID NO: 2261 - DNA, 495 bp, Artificial Sequence
  source: /note="Description of Artificial Sequence: Synthetic polynucleotide"
gcctccctcgcgccatcagtaggagaccactagctcagaaatgcagcaaaacccttcagagttaaagcaggagagaggttgtgaggactcacctgaggagacggtgaccagggttccctggccccagtagtcaaagtcgactaggagaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaataggagaccactagctctgagcgggctggcaaggc

SEQ ID NO: 2262 - DNA, 495 bp, Artificial Sequence
  source: /note="Description of Artificial Sequence: Synthetic polynucleotide"
gcctccctcgcgccatcagtaggagacggtcaactcagaaatgcagcaaaacccttcagagttaaagcaggagagaggttgtgaggactcacctgaggagacggtgaccagggttccctggccccagtagtcaaagtcgactaggagacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggataggagacggtcaactctgagcgggctggcaaggc

SEQ ID NO: 2263 - DNA, 495 bp, Artificial Sequence
  source: /note="Description of Artificial Sequence: Synthetic polynucleotide"
gcctccctcgcgccatcagtaggagactacgtacgcagaaatgcagcaaaacccttcagagttaaagcaggagagaggttgtgaggactcacctgaggagacggtgaccagggttccctggccccagtagtcaaagtcgactaggagactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatctaggagactacgtacgctgagcgggctggcaaggc

SEQ ID NO: 2264 - DNA, 495 bp, Artificial Sequence
  source: /note="Description of Artificial Sequence: Synthetic polynucleotide"
gcctccctcgcgccatcagtaggagacatgacacccagaaatgcagcaaaacccttcagagttaaagcaggagagaggttgtgaggactcacctgaggagacggtgaccagggttccctggccccagtagtcaaagtcgactaggagacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggtaggagacatgacaccctgagcgggctggcaaggc

SEQ ID NO: 2265 - DNA, 495 bp, Artificial Sequence
  source: /note="Description of Artificial Sequence: Synthetic polynucleotide"
gcctccctcgcgccatcagtaggagaccttcacgacagaaatgcagcaaaacccttcagagttaaagcaggagagaggttgtgaggactcacctgaggagacggtgaccagggttccctggccccagtagtcaaagtcgactaggagaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacactaggagaccttcacgactgagcgggctggcaaggc

SEQ ID NO: 2266 - DNA, 495 bp, Artificial Sequence
  source: /note="Description of Artificial Sequence: Synthetic polynucleotide"
gcctccctcgcgccatcagtaggagacagaatcagcagaaatgcagcaaaacccttcagagttaaagcaggagagaggttgtgaggactcacctgaggagacggtgaccagggttccctggccccagtagtcaaagtcgactaggagacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacctaggagacagaatcagctgagcgggctggcaaggc

SEQ ID NO: 2267 - DNA, 495 bp, Artificial Sequence
  source: /note="Description of Artificial Sequence: Synthetic polynucleotide"
gcctccctcgcgccatcagtaggagacagttatgccagaaatgcagcaaaacccttcagagttaaagcaggagagaggttgtgaggactcacctgaggagacggtgaccagggttccctggccccagtagtcaaagtcgactaggagacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataataggagacagttatgcctgagcgggctggcaaggc

SEQ ID NO: 2268 - DNA, 495 bp, Artificial Sequence
  source: /note="Description of Artificial Sequence: Synthetic polynucleotide"
gcctccctcgcgccatcagtaggagacaggtctcacagaaatgcagcaaaacccttcagagttaaagcaggagagaggttgtgaggactcacctgaggagacggtgaccagggttccctggccccagtagtcaaagtcgactaggagacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacctaggagacaggtctcactgagcgggctggcaaggc

SEQ ID NO: 2269 - DNA, 495 bp, Artificial Sequence
  source: /note="Description of Artificial Sequence: Synthetic polynucleotide"
gcctccctcgcgccatcagtaggagacgtcatagtcagaaatgcagcaaaacccttcagagttaaagcaggagagaggttgtgaggactcacctgaggagacggtgaccagggttccctggccccagtagtcaaagtcgactaggagacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggttaggagacgtcatagtctgagcgggctggcaaggc

SEQ ID NO: 2270 - DNA, 495 bp, Artificial Sequence
  source: /note="Description of Artificial Sequence: Synthetic polynucleotide"
gcctccctcgcgccatcagtaggagacgtgacttgcagaaatgcagcaaaacccttcagagttaaagcaggagagaggttgtgaggactcacctgaggagacggtgaccagggttccctggccccagtagtcaaagtcgactaggagacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgtaggagacgtgacttgctgagcgggctggcaaggc

SEQ ID NO: 2271 - DNA, 495 bp, Artificial Sequence
  source: /note="Description of Artificial Sequence: Synthetic polynucleotide"
gcctccctcgcgccatcagtaggagacgattgcagcagaaatgcagcaaaacccttcagagttaaagcaggagagaggttgtgaggactcacctgaggagacggtgaccagggttccctggccccagtagtcaaagtcgactaggagacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacctaggagacgattgcagctgagcgggctggcaaggc

SEQ ID NO: 2272 - DNA, 495 bp, Artificial Sequence
  source: /note="Description of Artificial Sequence: Synthetic polynucleotide"
gcctccctcgcgccatcagtaggagacactatgaccagaaatgcagcaaaacccttcagagttaaagcaggagagaggttgtgaggactcacctgaggagacggtgaccagggttccctggccccagtagtcaaagtcgactaggagacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaactaggagacactatgacctgagcgggctggcaaggc

SEQ ID NO: 2273 - DNA, 495 bp, Artificial Sequence
  source: /note="Description of Artificial Sequence: Synthetic polynucleotide"
gcctccctcgcgccatcagtaggagacatggtcaacagaaatgcagcaaaacccttcagagttaaagcaggagagaggttgtgaggactcacctgaggagacggtgaccagggttccctggccccagtagtcaaagtcgactaggagacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagactaggagacatggtcaactgagcgggctggcaaggc

SEQ ID NO: 2274 - DNA, 495 bp, Artificial Sequence
  source: /note="Description of Artificial Sequence: Synthetic polynucleotide"
gcctccctcgcgccatcagtaggagacgatggcttcagaaatgcagcaaaacccttcagagttaaagcaggagagaggttgtgaggactcacctgaggagacggtgaccagggttccctggccccagtagtcaaagtcgactaggagacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaactaggagacgatggcttctgagcgggctggcaaggc

SEQ ID NO: 2275 - DNA, 495 bp, Artificial Sequence
  source: /note="Description of Artificial Sequence: Synthetic polynucleotide"
gcctccctcgcgccatcagtaggagacagcatatgcagaaatgcagcaaaacccttcagagttaaagcaggagagaggttgtgaggactcacctgaggagacggtgaccagggttccctggccccagtagtcaaagtcgactaggagacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagactaggagacagcatatgctgagcgggctggcaaggc

SEQ ID NO: 2276 - DNA, 495 bp, Artificial Sequence
  source: /note="Description of Artificial Sequence: Synthetic polynucleotide"
gcctccctcgcgccatcagtaggagaccatatgctcagaaatgcagcaaaacccttcagagttaaagcaggagagaggttgtgaggactcacctgaggagacggtgaccagggttccctggccccagtagtcaaagtcgactaggagaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgtaggagaccatatgctctgagcgggctggcaaggc

SEQ ID NO: 2277 - DNA, 495 bp, Artificial Sequence
  source: /note="Description of Artificial Sequence: Synthetic polynucleotide"
gcctccctcgcgccatcagtaggagactcgtcgatcagaaatgcagcaaaacccttcagagttaaagcaggagagaggttgtgaggactcacctgaggagacggtgaccagggttccctggccccagtagtcaaagtcgactaggagactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacctaggagactcgtcgatctgagcgggctggcaaggc

SEQ ID NO: 2278 - DNA, 495 bp, Artificial Sequence
  source: /note="Description of Artificial Sequence: Synthetic polynucleotide"
gcctccctcgcgccatcagtaggagaccagtctgtcagaaatgcagcaaaacccttcagagttaaagcaggagagaggttgtgaggactcacctgaggagacggtgaccagggttccctggccccagtagtcaaagtcgactaggagaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgctaggagaccagtctgtctgagcgggctggcaaggc

SEQ ID NO: 2279 - DNA, 495 bp, Artificial Sequence
  source: /note="Description of Artificial Sequence: Synthetic polynucleotide"
gcctccctcgcgccatcagtaggagacaacgcgtacagaaatgcagcaaaacccttcagagttaaagcaggagagaggttgtgaggactcacctgaggagacggtgaccagggttccctggccccagtagtcaaagtcgactaggagacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgtaggagacaacgcgtactgagcgggctggcaaggc

SEQ ID NO: 2280 - DNA, 495 bp, Artificial Sequence
  source: /note="Description of Artificial Sequence: Synthetic polynucleotide"
gcctccctcgcgccatcagtaggagacgtagttcgcagaaatgcagcaaaacccttcagagttaaagcaggagagaggttgtgaggactcacctgaggagacggtgaccagggttccctggccccagtagtcaaagtcgactaggagacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgctaggagacgtagttcgctgagcgggctggcaaggc

SEQ ID NO: 2281 - DNA, 495 bp, Artificial Sequence
  source: /note="Description of Artificial Sequence: Synthetic polynucleotide"
gcctccctcgcgccatcagtaggagaccgaactaccagaaatgcagcaaaacccttcagagttaaagcaggagagaggttgtgaggactcacctgaggagacggtgaccagggttccctggccccagtagtcaaagtcgactaggagaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagactaggagaccgaactacctgagcgggctggcaaggc

SEQ ID NO: 2282 - DNA, 495 bp, Artificial Sequence
  source: /note="Description of Artificial Sequence: Synthetic polynucleotide"
gcctccctcgcgccatcagtaggagacttaacgtccagaaatgcagcaaaacccttcagagttaaagcaggagagaggttgtgaggactcacctgaggagacggtgaccagggttccctggccccagtagtcaaagtcgactaggagacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacctaggagacttaacgtcctgagcgggctggcaaggc

SEQ ID NO: 2283 - DNA, 495 bp, Artificial Sequence
  source: /note="Description of Artificial Sequence: Synthetic polynucleotide"
gcctccctcgcgccatcagtaggagacagcaacctcagaaatgcagcaaaacccttcagagttaaagcaggagagaggttgtgaggactcacctgaggagacggtgaccagggttccctggccccagtagtcaaagtcgactaggagacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggactaggagacagcaacctctgagcgggctggcaaggc

SEQ ID NO: 2284 - DNA, 495 bp, Artificial Sequence
  source: /note="Description of Artificial Sequence: Synthetic polynucleotide"
gcctccctcgcgccatcagtaggagacttctcgagcagaaatgcagcaaaacccttcagagttaaagcaggagagaggttgtgaggactcacctgaggagacggtgaccagggttccctggccccagtagtcaaagtcgactaggagacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggactttaggagacttctcgagctgagcgggctggcaaggc

SEQ ID NO: 2285 - DNA, 495 bp, Artificial Sequence
  source: /note="Description of Artificial Sequence: Synthetic polynucleotide"
gcctccctcgcgccatcagtaggagacactctacgcagaaatgcagcaaaacccttcagagttaaagcaggagagaggttgtgaggactcacctgaggagacggtgaccagggttccctggccccagtagtcaaagtcgactaggagacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggactaggagacactctacgctgagcgggctggcaaggc

SEQ ID NO: 2286 - DNA, 495 bp, Artificial Sequence
  source: /note="Description of Artificial Sequence: Synthetic polynucleotide"
gcctccctcgcgccatcagtaggagactaccggaacagaaatgcagcaaaacccttcagagttaaagcaggagagaggttgtgaggactcacctgaggagacggtgaccagggttccctggccccagtagtcaaagtcgactaggagactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacctaggagactaccggaactgagcgggctggcaaggc

SEQ ID NO: 2287 - DNA, 495 bp, Artificial Sequence
  source: /note="Description of Artificial Sequence: Synthetic polynucleotide"
gcctccctcgcgccatcagtaggagaccgaattgccagaaatgcagcaaaacccttcagagttaaagcaggagagaggttgtgaggactcacctgaggagacggtgaccagggttccctggccccagtagtcaaagtcgactaggagaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaactaggagaccgaattgcctgagcgggctggcaaggc

SEQ ID NO: 2288 - DNA, 495 bp, Artificial Sequence
  source: /note="Description of Artificial Sequence: Synthetic polynucleotide"
gcctccctcgcgccatcagtaggagacttcgctcacagaaatgcagcaaaacccttcagagttaaagcaggagagaggttgtgaggactcacctgaggagacggtgaccagggttccctggccccagtagtcaaagtcgactaggagacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacataggagacttcgctcactgagcgggctggcaaggc

SEQ ID NO: 2289 - DNA, 495 bp, Artificial Sequence
  source: /note="Description of Artificial Sequence: Synthetic polynucleotide"
gcctccctcgcgccatcagtaggagacgacgttaacagaaatgcagcaaaacccttcagagttaaagcaggagagaggttgtgaggactcacctgaggagacggtgaccagggttccctggccccagtagtcaaagtcgactaggagacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgtaggagacgacgttaactgagcgggctggcaaggc

SEQ ID NO: 2290 - DNA, 495 bp, Artificial Sequence
  source: /note="Description of Artificial Sequence: Synthetic polynucleotide"
gcctccctcgcgccatcagtaggagaccgtagagtcagaaatgcagcaaaacccttcagagttaaagcaggagagaggttgtgaggactcacctgaggagacggtgaccagggttccctggccccagtagtcaaagtcgactaggagaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgctaggagaccgtagagtctgagcgggctggcaaggc

SEQ ID NO: 2291 - DNA, 495 bp, Artificial Sequence
  source: /note="Description of Artificial Sequence: Synthetic polynucleotide"
gcctccctcgcgccatcagtaggagacttccggtacagaaatgcagcaaaacccttcagagttaaagcaggagagaggttgtgaggactcacctgaggagacggtgaccagggttccctggccccagtagtcaaagtcgactaggagacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgctaggagacttccggtactgagcgggctggcaaggc

SEQ ID NO: 2292 - DNA, 495 bp, Artificial Sequence
  source: /note="Description of Artificial Sequence: Synthetic polynucleotide"
gcctccctcgcgccatcagtaggagacgcaattcgcagaaatgcagcaaaacccttcagagttaaagcaggagagaggttgtgaggactcacctgaggagacggtgaccagggttccctggccccagtagtcaaagtcgactaggagacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacactaggagacgcaattcgctgagcgggctggcaaggc

SEQ ID NO: 2293 - DNA, 495 bp, Artificial Sequence
  source: /note="Description of Artificial Sequence: Synthetic polynucleotide"
gcctccctcgcgccatcagtaggagactgagcgaacagaaatgcagcaaaacccttcagagttaaagcaggagagaggttgtgaggactcacctgaggagacggtgaccagggttccctggccccagtagtcaaagtcgactaggagactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgctaggagactgagcgaactgagcgggctggcaaggc

SEQ ID NO: 2294 - DNA, 495 bp, Artificial Sequence
  source: /note="Description of Artificial Sequence: Synthetic polynucleotide"
gcctccctcgcgccatcagtaggagactactaagccagaaatgcagcaaaacccttcagagttaaagcaggagagaggttgtgaggactcacctgaggagacggtgaccagggttccctggccccagtagtcaaagtcgactaggagactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccctaggagactactaagcctgagcgggctggcaaggc

SEQ ID NO: 2295 - DNA, 495 bp, Artificial Sequence
  source: /note="Description of Artificial Sequence: Synthetic polynucleotide"
gcctccctcgcgccatcagtaggagactggcgtatcagaaatgcagcaaaacccttcagagttaaagcaggagagaggttgtgaggactcacctgaggagacggtgaccagggttccctggccccagtagtcaaagtcgactaggagactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgttaggagactggcgtatctgagcgggctggcaaggc

SEQ ID NO: 2296 - DNA, 495 bp, Artificial Sequence
  source: /note="Description of Artificial Sequence: Synthetic polynucleotide"
gcctccctcgcgccatcagtaggagacgataaccacagaaatgcagcaaaacccttcagagttaaagcaggagagaggttgtgaggactcacctgaggagacggtgaccagggttccctggccccagtagtcaaagtcgactaggagacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgtaggagacgataaccactgagcgggctggcaaggc

SEQ ID NO: 2297 - DNA, 495 bp, Artificial Sequence
  source: /note="Description of Artificial Sequence: Synthetic polynucleotide"
gcctccctcgcgccatcagtaggagacctagtgaacagaaatgcagcaaaacccttcagagttaaagcaggagagaggttgtgaggactcacctgaggagacggtgaccagggttccctggccccagtagtcaaagtcgactaggagacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagtaggagacctagtgaactgagcgggctggcaaggc

SEQ ID NO: 2298 - DNA, 495 bp, Artificial Sequence
  source: /note="Description of Artificial Sequence: Synthetic polynucleotide"
gcctccctcgcgccatcagtaggagacacgttcaccagaaatgcagcaaaacccttcagagttaaagcaggagagaggttgtgaggactcacctgaggagacggtgaccagggttccctggccccagtagtcaaagtcgactaggagacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgttaggagacacgttcacctgagcgggctggcaaggc

SEQ ID NO: 2299 - DNA, 448 bp, Artificial Sequence
  source: /note="Description of Artificial Sequence: Synthetic polynucleotide"
gcctccctcgcgccatcagtaggagacattacgctcagaaatgcagcaaaacccttcagagttaaagcaggagagaggttgtgaggactcacctgaggagacggtgaccagggttccctggccccagtagtcaaagtcgactaggagacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcataggagacattacgctctgagcgggctggcaaggc

SEQ ID NO: 2300 - DNA, 495 bp, Artificial Sequence
  source: /note="Description of Artificial Sequence: Synthetic polynucleotide"
gcctccctcgcgccatcagtaggagaccattgagtcagaaatgcagcaaaacccttcagagttaaagcaggagagaggttgtgaggactcacctgaggagacggtgaccagggttccctggccccagtagtcaaagtcgactaggagaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacctaggagaccattgagtctgagcgggctggcaaggc

SEQ ID NO: 2301 - DNA, 495 bp, Artificial Sequence
  source: /note="Description of Artificial Sequence: Synthetic polynucleotide"
gcctccctcgcgccatcaggacactctcttggttactggcaagctgagtctccctaagtggactcagagagggggtggtgaggactcacctgaggagacggtgaccagggttccctggccccaggggtcgaaccagtcgacgacactctcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgacactctcttggttactgagcgggctggcaaggc

SEQ ID NO: 2302 - DNA, 495 bp, Artificial Sequence
  source: /note="Description of Artificial Sequence: Synthetic polynucleotide"
gcctccctcgcgccatcaggacactctacctcttgctggcaagctgagtctccctaagtggactcagagagggggtggtgaggactcacctgaggagacggtgaccagggttccctggccccaggggtcgaaccagtcgacgacactctacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgacactctacctcttgctgagcgggctggcaaggc

SEQ ID NO: 2303 - DNA, 495 bp, Artificial Sequence
  source: /note="Description of Artificial Sequence: Synthetic polynucleotide"
gcctccctcgcgccatcaggacactctctgattctctggcaagctgagtctccctaagtggactcagagagggggtggtgaggactcacctgaggagacggtgaccagggttccctggccccaggggtcgaaccagtcgacgacactctctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgacactctctgattctctgagcgggctggcaaggc

SEQ ID NO: 2304 - DNA, 495 bp, Artificial Sequence
  source: /note="Description of Artificial Sequence: Synthetic polynucleotide"
gcctccctcgcgccatcaggacactctagtaccgactggcaagctgagtctccctaagtggactcagagagggggtggtgaggactcacctgaggagacggtgaccagggttccctggccccaggggtcgaaccagtcgacgacactctagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgacactctagtaccgactgagcgggctggcaaggc

SEQ ID NO: 2305 - DNA, 495 bp, Artificial Sequence
  source: /note="Description of Artificial Sequence: Synthetic polynucleotide"
gcctccctcgcgccatcaggacactctatccatggctggcaagctgagtctccctaagtggactcagagagggggtggtgaggactcacctgaggagacggtgaccagggttccctggccccaggggtcgaaccagtcgacgacactctatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgacactctatccatggctgagcgggctggcaaggc

SEQ ID NO: 2306 - DNA, 495 bp, Artificial Sequence
  source: /note="Description of Artificial Sequence: Synthetic polynucleotide"
gcctccctcgcgccatcaggacactctgtagcagtctggcaagctgagtctccctaagtggactcagagagggggtggtgaggactcacctgaggagacggtgaccagggttccctggccccaggggtcgaaccagtcgacgacactctgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgacactctgtagcagtctgagcgggctggcaaggc

SEQ ID NO: 2307 - DNA, 495 bp, Artificial Sequence
  source: /note="Description of Artificial Sequence: Synthetic polynucleotide"
gcctccctcgcgccatcaggacactctatcttcgtctggcaagctgagtctccctaagtggactcagagagggggtggtgaggactcacctgaggagacggtgaccagggttccctggccccaggggtcgaaccagtcgacgacactctatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgacactctatcttcgtctgagcgggctggcaaggc

SEQ ID NO: 2308 - DNA, 495 bp, Artificial Sequence
  source: /note="Description of Artificial Sequence: Synthetic polynucleotide"
gcctccctcgcgccatcaggacactcttccacagtctggcaagctgagtctccctaagtggactcagagagggggtggtgaggactcacctgaggagacggtgaccagggttccctggccccaggggtcgaaccagtcgacgacactcttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgacactcttccacagtctgagcgggctggcaaggc

SEQ ID NO: 2309 - DNA, 495 bp, Artificial Sequence
  source: /note="Description of Artificial Sequence: Synthetic polynucleotide"
gcctccctcgcgccatcaggacactctagctagtgctggcaagctgagtctccctaagtggactcagagagggggtggtgaggactcacctgaggagacggtgaccagggttccctggccccaggggtcgaaccagtcgacgacactctagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgacactctagctagtgctgagcgggctggcaaggc

SEQ ID NO: 2310 - DNA, 495 bp, Artificial Sequence
  source: /note="Description of Artificial Sequence: Synthetic polynucleotide"
gcctccctcgcgccatcaggacactcttaaccaagctggcaagctgagtctccctaagtggactcagagagggggtggtgaggactcacctgaggagacggtgaccagggttccctggccccaggggtcgaaccagtcgacgacactcttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgacactcttaaccaagctgagcgggctggcaaggc

SEQ ID NO: 2311 - DNA, 495 bp, Artificial Sequence
  source: /note="Description of Artificial Sequence: Synthetic polynucleotide"
gcctccctcgcgccatcaggacactctcaagaggtctggcaagctgagtctccctaagtggactcagagagggggtggtgaggactcacctgaggagacggtgaccagggttccctggccccaggggtcgaaccagtcgacgacactctcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgacactctcaagaggtctgagcgggctggcaaggc

SEQ ID NO: 2312 - DNA, 495 bp, Artificial Sequence
  source: /note="Description of Artificial Sequence: Synthetic polynucleotide"
gcctccctcgcgccatcaggacactctagttgaccctggcaagctgagtctccctaagtggactcagagagggggtggtgaggactcacctgaggagacggtgaccagggttccctggccccaggggtcgaaccagtcgacgacactctagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagacactctagttgaccctgagcgggctggcaaggc

SEQ ID NO: 2313 - DNA, 495 bp, Artificial Sequence
  source: /note="Description of Artificial Sequence: Synthetic polynucleotide"
gcctccctcgcgccatcaggacactctcagcatatctggcaagctgagtctccctaagtggactcagagagggggtggtgaggactcacctgaggagacggtgaccagggttccctggccccaggggtcgaaccagtcgacgacactctcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagacactctcagcatatctgagcgggctggcaaggc

SEQ ID NO: 2314 - DNA, 495 bp, Artificial Sequence
  source: /note="Description of Artificial Sequence: Synthetic polynucleotide"
gcctccctcgcgccatcaggacactctgcaggattctggcaagctgagtctccctaagtggactcagagagggggtggtgaggactcacctgaggagacggtgaccagggttccctggccccaggggtcgaaccagtcgacgacactctgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagacactctgcaggattctgagcgggctggcaaggc

SEQ ID NO: 2315 - DNA, 495 bp, Artificial Sequence
  source: /note="Description of Artificial Sequence: Synthetic polynucleotide"
gcctccctcgcgccatcaggacactctgtccattcctggcaagctgagtctccctaagtggactcagagagggggtggtgaggactcacctgaggagacggtgaccagggttccctggccccaggggtcgaaccagtcgacgacactctgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgacactctgtccattcctgagcgggctggcaaggc

SEQ ID NO: 2316 - DNA, 495 bp, Artificial Sequence
  source: /note="Description of Artificial Sequence: Synthetic polynucleotide"
gcctccctcgcgccatcaggacactctgcataactctggcaagctgagtctccctaagtggactcagagagggggtggtgaggactcacctgaggagacggtgaccagggttccctggccccaggggtcgaaccagtcgacgacactctgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgacactctgcataactctgagcgggctggcaaggc

SEQ ID NO: 2317 - DNA, 495 bp, Artificial Sequence
  source: /note="Description of Artificial Sequence: Synthetic polynucleotide"
gcctccctcgcgccatcaggacactctatatgctgctggcaagctgagtctccctaagtggactcagagagggggtggtgaggactcacctgaggagacggtgaccagggttccctggccccaggggtcgaaccagtcgacgacactctatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgacactctatatgctgctgagcgggctggcaaggc

SEQ ID NO: 2318 - DNA, 495 bp, Artificial Sequence
  source: /note="Description of Artificial Sequence: Synthetic polynucleotide"
gcctccctcgcgccatcaggacactctaatcctgcctggcaagctgagtctccctaagtggactcagagagggggtggtgaggactcacctgaggagacggtgaccagggttccctggccccaggggtcgaaccagtcgacgacactctaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgacactctaatcctgcctgagcgggctggcaaggc

SEQ ID NO: 2319 - DNA, 495 bp, Artificial Sequence
  source: /note="Description of Artificial Sequence: Synthetic polynucleotide"
gcctccctcgcgccatcaggacactcttgagacctctggcaagctgagtctccctaagtggactcagagagggggtggtgaggactcacctgaggagacggtgaccagggttccctggccccaggggtcgaaccagtcgacgacactcttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggacactcttgagacctctgagcgggctggcaaggc

SEQ ID NO: 2320 - DNA, 495 bp, Artificial Sequence
  source: /note="Description of Artificial Sequence: Synthetic polynucleotide"
gcctccctcgcgccatcaggacactctgaatggacctggcaagctgagtctccctaagtggactcagagagggggtggtgaggactcacctgaggagacggtgaccagggttccctggccccaggggtcgaaccagtcgacgacactctgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgacactctgaatggacctgagcgggctggcaaggc

SEQ ID NO: 2321 - DNA, 495 bp, Artificial Sequence
  source: /note="Description of Artificial Sequence: Synthetic polynucleotide"
gcctccctcgcgccatcaggacactctcacatggactggcaagctgagtctccctaagtggactcagagagggggtggtgaggactcacctgaggagacggtgaccagggttccctggccccaggggtcgaaccagtcgacgacactctcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgacactctcacatggactgagcgggctggcaaggc

SEQ ID NO: 2322 - DNA, 495 bp, Artificial Sequence
  source: /note="Description of Artificial Sequence: Synthetic polynucleotide"
gcctccctcgcgccatcaggacactctttgaccatctggcaagctgagtctccctaagtggactcagagagggggtggtgaggactcacctgaggagacggtgaccagggttccctggccccaggggtcgaaccagtcgacgacactctttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgacactctttgaccatctgagcgggctggcaaggc

SEQ ID NO: 2323 - DNA, 495 bp, Artificial Sequence
  source: /note="Description of Artificial Sequence: Synthetic polynucleotide"
gcctccctcgcgccatcaggacactctaagccatcctggcaagctgagtctccctaagtggactcagagagggggtggtgaggactcacctgaggagacggtgaccagggttccctggccccaggggtcgaaccagtcgacgacactctaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgacactctaagccatcctgagcgggctggcaaggc

SEQ ID NO: 2324 - DNA, 495 bp, Artificial Sequence
  source: /note="Description of Artificial Sequence: Synthetic polynucleotide"
gcctccctcgcgccatcaggacactcttccatgtgctggcaagctgagtctccctaagtggactcagagagggggtggtgaggactcacctgaggagacggtgaccagggttccctggccccaggggtcgaaccagtcgacgacactcttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactcttccatgtgctgagcgggctggcaaggc

SEQ ID NO: 2325 - DNA, 495 bp, Artificial Sequence
  source: /note="Description of Artificial Sequence: Synthetic polynucleotide"
gcctccctcgcgccatcaggacactctcaagtcacctggcaagctgagtctccctaagtggactcagagagggggtggtgaggactcacctgaggagacggtgaccagggttccctggccccaggggtcgaaccagtcgacgacactctcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactctcaagtcacctgagcgggctggcaaggc

SEQ ID NO: 2326 - DNA, 495 bp, Artificial Sequence
  source: /note="Description of Artificial Sequence: Synthetic polynucleotide"
gcctccctcgcgccatcaggacactctctgcaatcctggcaagctgagtctccctaagtggactcagagagggggtggtgaggactcacctgaggagacggtgaccagggttccctggccccaggggtcgaaccagtcgacgacactctctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgacactctctgcaatcctgagcgggctggcaaggc

SEQ ID NO: 2327 - DNA, 495 bp, Artificial Sequence
  source: /note="Description of Artificial Sequence: Synthetic polynucleotide"
gcctccctcgcgccatcaggacactctatcgacgactggcaagctgagtctccctaagtggactcagagagggggtggtgaggactcacctgaggagacggtgaccagggttccctggccccaggggtcgaaccagtcgacgacactctatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgacactctatcgacgactgagcgggctggcaaggc

SEQ ID NO: 2328 - DNA, 495 bp, Artificial Sequence
  source: /note="Description of Artificial Sequence: Synthetic polynucleotide"
gcctccctcgcgccatcaggacactctacagactgctggcaagctgagtctccctaagtggactcagagagggggtggtgaggactcacctgaggagacggtgaccagggttccctggccccaggggtcgaaccagtcgacgacactctacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagacactctacagactgctgagcgggctggcaaggc

SEQ ID NO: 2329 - DNA, 495 bp, Artificial Sequence
  source: /note="Description of Artificial Sequence: Synthetic polynucleotide"
gcctccctcgcgccatcaggacactctccttatagctggcaagctgagtctccctaagtggactcagagagggggtggtgaggactcacctgaggagacggtgaccagggttccctggccccaggggtcgaaccagtcgacgacactctccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgacactctccttatagctgagcgggctggcaaggc

SEQ ID NO: 2330 - DNA, 495 bp, Artificial Sequence
  source: /note="Description of Artificial Sequence: Synthetic polynucleotide"
gcctccctcgcgccatcaggacactcttacgcgttctggcaagctgagtctccctaagtggactcagagagggggtggtgaggactcacctgaggagacggtgaccagggttccctggccccaggggtcgaaccagtcgacgacactcttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgacactcttacgcgttctgagcgggctggcaaggc

SEQ ID NO: 2331 - DNA, 495 bp, Artificial Sequence
  source: /note="Description of Artificial Sequence: Synthetic polynucleotide"
gcctccctcgcgccatcaggacactctctataaggctggcaagctgagtctccctaagtggactcagagagggggtggtgaggactcacctgaggagacggtgaccagggttccctggccccaggggtcgaaccagtcgacgacactctctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggacactctctataaggctgagcgggctggcaaggc

SEQ ID NO: 2332 - DNA, 495 bp, Artificial Sequence
  source: /note="Description of Artificial Sequence: Synthetic polynucleotide"
gcctccctcgcgccatcaggacactcttcttagtcctggcaagctgagtctccctaagtggactcagagagggggtggtgaggactcacctgaggagacggtgaccagggttccctggccccaggggtcgaaccagtcgacgacactcttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactcttcttagtcctgagcgggctggcaaggc

SEQ ID NO: 2333 - DNA, 495 bp, Artificial Sequence
  source: /note="Description of Artificial Sequence: Synthetic polynucleotide"
gcctccctcgcgccatcaggacactcttgtctgcactggcaagctgagtctccctaagtggactcagagagggggtggtgaggactcacctgaggagacggtgaccagggttccctggccccaggggtcgaaccagtcgacgacactcttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgacactcttgtctgcactgagcgggctggcaaggc

SEQ ID NO: 2334 - DNA, 495 bp, Artificial Sequence
  source: /note="Description of Artificial Sequence: Synthetic polynucleotide"
gcctccctcgcgccatcaggacactctgccattaactggcaagctgagtctccctaagtggactcagagagggggtggtgaggactcacctgaggagacggtgaccagggttccctggccccaggggtcgaaccagtcgacgacactctgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactctgccattaactgagcgggctggcaaggc

SEQ ID NO: 2335 - DNA, 495 bp, Artificial Sequence
  source: /note="Description of Artificial Sequence: Synthetic polynucleotide"
gcctccctcgcgccatcaggacactctgactaagactggcaagctgagtctccctaagtggactcagagagggggtggtgaggactcacctgaggagacggtgaccagggttccctggccccaggggtcgaaccagtcgacgacactctgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggacactctgactaagactgagcgggctggcaaggc

SEQ ID NO: 2336 - DNA, 495 bp, Artificial Sequence
  source: /note="Description of Artificial Sequence: Synthetic polynucleotide"
gcctccctcgcgccatcaggacactctaggttgctctggcaagctgagtctccctaagtggactcagagagggggtggtgaggactcacctgaggagacggtgaccagggttccctggccccaggggtcgaaccagtcgacgacactctaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggacactctaggttgctctgagcgggctggcaaggc

SEQ ID NO: 2337 - DNA, 495 bp, Artificial Sequence
  source: /note="Description of Artificial Sequence: Synthetic polynucleotide"
gcctccctcgcgccatcaggacactctctcgagaactggcaagctgagtctccctaagtggactcagagagggggtggtgaggactcacctgaggagacggtgaccagggttccctggccccaggggtcgaaccagtcgacgacactctctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgacactctctcgagaactgagcgggctggcaaggc

SEQ ID NO: 2338 - DNA, 495 bp, Artificial Sequence
  source: /note="Description of Artificial Sequence: Synthetic polynucleotide"
gcctccctcgcgccatcaggacactctttaatggcctggcaagctgagtctccctaagtggactcagagagggggtggtgaggactcacctgaggagacggtgaccagggttccctggccccaggggtcgaaccagtcgacgacactctttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgacactctttaatggcctgagcgggctggcaaggc

SEQ ID NO: 2339 - DNA, 495 bp, Artificial Sequence
  source: /note="Description of Artificial Sequence: Synthetic polynucleotide"
gcctccctcgcgccatcaggacactcttgcagacactggcaagctgagtctccctaagtggactcagagagggggtggtgaggactcacctgaggagacggtgaccagggttccctggccccaggggtcgaaccagtcgacgacactcttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagacactcttgcagacactgagcgggctggcaaggc

SEQ ID NO: 2340 - DNA, 495 bp, Artificial Sequence
  source: /note="Description of Artificial Sequence: Synthetic polynucleotide"
gcctccctcgcgccatcaggacactcttcactgagctggcaagctgagtctccctaagtggactcagagagggggtggtgaggactcacctgaggagacggtgaccagggttccctggccccaggggtcgaaccagtcgacgacactcttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgacactcttcactgagctgagcgggctggcaaggc

SEQ ID NO: 2341 - DNA, 495 bp, Artificial Sequence
  source: /note="Description of Artificial Sequence: Synthetic polynucleotide"
gcctccctcgcgccatcaggacactctgagtacgtctggcaagctgagtctccctaagtggactcagagagggggtggtgaggactcacctgaggagacggtgaccagggttccctggccccaggggtcgaaccagtcgacgacactctgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgacactctgagtacgtctgagcgggctggcaaggc

SEQ ID NO: 2342 - DNA, 495 bp, Artificial Sequence
  source: /note="Description of Artificial Sequence: Synthetic polynucleotide"
gcctccctcgcgccatcaggacactctatacgccactggcaagctgagtctccctaagtggactcagagagggggtggtgaggactcacctgaggagacggtgaccagggttccctggccccaggggtcgaaccagtcgacgacactctatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgacactctatacgccactgagcgggctggcaaggc

SEQ ID NO: 2343 - DNA, 495 bp, Artificial Sequence
  source: /note="Description of Artificial Sequence: Synthetic polynucleotide"
gcctccctcgcgccatcaggacactcttcgcatcactggcaagctgagtctccctaagtggactcagagagggggtggtgaggactcacctgaggagacggtgaccagggttccctggccccaggggtcgaaccagtcgacgacactcttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgacactcttcgcatcactgagcgggctggcaaggc

SEQ ID NO: 2344 - DNA, 495 bp, Artificial Sequence
  source: /note="Description of Artificial Sequence: Synthetic polynucleotide"
gcctccctcgcgccatcaggacactctcgcttaatctggcaagctgagtctccctaagtggactcagagagggggtggtgaggactcacctgaggagacggtgaccagggttccctggccccaggggtcgaaccagtcgacgacactctcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgacactctcgcttaatctgagcgggctggcaaggc

SEQ ID NO: 2345 - DNA, 495 bp, Artificial Sequence
  source: /note="Description of Artificial Sequence: Synthetic polynucleotide"
gcctccctcgcgccatcaggacactcttggttatcctggcaagctgagtctccctaagtggactcagagagggggtggtgaggactcacctgaggagacggtgaccagggttccctggccccaggggtcgaaccagtcgacgacactcttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgacactcttggttatcctgagcgggctggcaaggc

SEQ ID NO: 2346 - DNA, 495 bp, Artificial Sequence
  source: /note="Description of Artificial Sequence: Synthetic polynucleotide"
gcctccctcgcgccatcaggacactctggattgctctggcaagctgagtctccctaagtggactcagagagggggtggtgaggactcacctgaggagacggtgaccagggttccctggccccaggggtcgaaccagtcgacgacactctggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgacactctggattgctctgagcgggctggcaaggc

SEQ ID NO: 2347 - DNA, 495 bp, Artificial Sequence
  source: /note="Description of Artificial Sequence: Synthetic polynucleotide"
gcctccctcgcgccatcaggacactctctcagtgactggcaagctgagtctccctaagtggactcagagagggggtggtgaggactcacctgaggagacggtgaccagggttccctggccccaggggtcgaaccagtcgacgacactctctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgacactctctcagtgactgagcgggctggcaaggc

SEQ ID NO: 2348 - DNA, 495 bp, Artificial Sequence
  source: /note="Description of Artificial Sequence: Synthetic polynucleotide"
gcctccctcgcgccatcaggacactctacgtactcctggcaagctgagtctccctaagtggactcagagagggggtggtgaggactcacctgaggagacggtgaccagggttccctggccccaggggtcgaaccagtcgacgacactctacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgacactctacgtactcctgagcgggctggcaaggc

SEQ ID NO: 2349 - DNA, 495 bp, Artificial Sequence
  source: /note="Description of Artificial Sequence: Synthetic polynucleotide"
gcctccctcgcgccatcaggacactcttgatgcgactggcaagctgagtctccctaagtggactcagagagggggtggtgaggactcacctgaggagacggtgaccagggttccctggccccaggggtcgaaccagtcgacgacactcttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgacactcttgatgcgactgagcgggctggcaaggc

SEQ ID NO: 2350 - DNA, 495 bp, Artificial Sequence
  source: /note="Description of Artificial Sequence: Synthetic polynucleotide"
gcctccctcgcgccatcaggacactctattaagcgctggcaagctgagtctccctaagtggactcagagagggggtggtgaggactcacctgaggagacggtgaccagggttccctggccccaggggtcgaaccagtcgacgacactctattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgacactctattaagcgctgagcgggctggcaaggc

SEQ ID NO: 2351 - DNA, 495 bp, Artificial Sequence
  source: /note="Description of Artificial Sequence: Synthetic polynucleotide"
gcctccctcgcgccatcaggacactctagcaatccctggcaagctgagtctccctaagtggactcagagagggggtggtgaggactcacctgaggagacggtgaccagggttccctggccccaggggtcgaaccagtcgacgacactctagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgacactctagcaatccctgagcgggctggcaaggc

SEQ ID NO: 2352 - DNA, 495 bp, Artificial Sequence
  source: /note="Description of Artificial Sequence: Synthetic polynucleotide"
gcctccctcgcgccatcaggacactctgcttagtactggcaagctgagtctccctaagtggactcagagagggggtggtgaggactcacctgaggagacggtgaccagggttccctggccccaggggtcgaaccagtcgacgacactctgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagacactctgcttagtactgagcgggctggcaaggc

SEQ ID NO: 2353 - DNA, 495 bp, Artificial Sequence
  source: /note="Description of Artificial Sequence: Synthetic polynucleotide"
gcctccctcgcgccatcaggacactcttgaccttgctggcaagctgagtctccctaagtggactcagagagggggtggtgaggactcacctgaggagacggtgaccagggttccctggccccaggggtcgaaccagtcgacgacactcttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgacactcttgaccttgctgagcgggctggcaaggc

SEQ ID NO: 2354 - DNA, 495 bp, Artificial Sequence
  source: /note="Description of Artificial Sequence: Synthetic polynucleotide"
gcctccctcgcgccatcaggacactctcaaggtcactggcaagctgagtctccctaagtggactcagagagggggtggtgaggactcacctgaggagacggtgaccagggttccctggccccaggggtcgaaccagtcgacgacactctcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgacactctcaaggtcactgagcgggctggcaaggc

SEQ ID NO: 2355 - DNA, 495 bp, Artificial Sequence
  source: /note="Description of Artificial Sequence: Synthetic polynucleotide"
gcctccctcgcgccatcaggacactctcactgtacctggcaagctgagtctccctaagtggactcagagagggggtggtgaggactcacctgaggagacggtgaccagggttccctggccccaggggtcgaaccagtcgacgacactctcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgacactctcactgtacctgagcgggctggcaaggc

SEQ ID NO: 2356 - DNA, 495 bp, Artificial Sequence
  source: /note="Description of Artificial Sequence: Synthetic polynucleotide"
gcctccctcgcgccatcaggacactctgatgatccctggcaagctgagtctccctaagtggactcagagagggggtggtgaggactcacctgaggagacggtgaccagggttccctggccccaggggtcgaaccagtcgacgacactctgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggacactctgatgatccctgagcgggctggcaaggc

SEQ ID NO: 2357 - DNA, 495 bp, Artificial Sequence
  source: /note="Description of Artificial Sequence: Synthetic polynucleotide"
gcctccctcgcgccatcaggacactctcgccaatactggcaagctgagtctccctaagtggactcagagagggggtggtgaggactcacctgaggagacggtgaccagggttccctggccccaggggtcgaaccagtcgacgacactctcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggacactctcgccaatactgagcgggctggcaaggc

SEQ ID NO: 2358 - DNA, 495 bp, Artificial Sequence
  source: /note="Description of Artificial Sequence: Synthetic polynucleotide"
gcctccctcgcgccatcaggacactcttcaagcctctggcaagctgagtctccctaagtggactcagagagggggtggtgaggactcacctgaggagacggtgaccagggttccctggccccaggggtcgaaccagtcgacgacactcttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagacactcttcaagcctctgagcgggctggcaaggc

SEQ ID NO: 2359 - DNA, 495 bp, Artificial Sequence
  source: /note="Description of Artificial Sequence: Synthetic polynucleotide"
gcctccctcgcgccatcaggacactctacgtgtgtctggcaagctgagtctccctaagtggactcagagagggggtggtgaggactcacctgaggagacggtgaccagggttccctggccccaggggtcgaaccagtcgacgacactctacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggacactctacgtgtgtctgagcgggctggcaaggc

SEQ ID NO: 2360 - DNA, 495 bp, Artificial Sequence
  source: /note="Description of Artificial Sequence: Synthetic polynucleotide"
gcctccctcgcgccatcaggacactcttccgtctactggcaagctgagtctccctaagtggactcagagagggggtggtgaggactcacctgaggagacggtgaccagggttccctggccccaggggtcgaaccagtcgacgacactcttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggacactcttccgtctactgagcgggctggcaaggc

SEQ ID NO: 2361 - DNA, 495 bp, Artificial Sequence
  source: /note="Description of Artificial Sequence: Synthetic polynucleotide"
gcctccctcgcgccatcaggacactctaagagctgctggcaagctgagtctccctaagtggactcagagagggggtggtgaggactcacctgaggagacggtgaccagggttccctggccccaggggtcgaaccagtcgacgacactctaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggacactctaagagctgctgagcgggctggcaaggc

SEQ ID NO: 2362 - DNA, 495 bp, Artificial Sequence
  source: /note="Description of Artificial Sequence: Synthetic polynucleotide"
gcctccctcgcgccatcaggacactcttatcgctcctggcaagctgagtctccctaagtggactcagagagggggtggtgaggactcacctgaggagacggtgaccagggttccctggccccaggggtcgaaccagtcgacgacactcttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggacactcttatcgctcctgagcgggctggcaaggc

SEQ ID NO: 2363 - DNA, 495 bp, Artificial Sequence
  source: /note="Description of Artificial Sequence: Synthetic polynucleotide"
gcctccctcgcgccatcaggacactcttcagatgcctggcaagctgagtctccctaagtggactcagagagggggtggtgaggactcacctgaggagacggtgaccagggttccctggccccaggggtcgaaccagtcgacgacactcttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgacactcttcagatgcctgagcgggctggcaaggc

SEQ ID NO: 2364 - DNA, 495 bp, Artificial Sequence
  source: /note="Description of Artificial Sequence: Synthetic polynucleotide"
gcctccctcgcgccatcaggacactctgtgtagcactggcaagctgagtctccctaagtggactcagagagggggtggtgaggactcacctgaggagacggtgaccagggttccctggccccaggggtcgaaccagtcgacgacactctgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggacactctgtgtagcactgagcgggctggcaaggc

SEQ ID NO: 2365 - DNA, 495 bp, Artificial Sequence
  source: /note="Description of Artificial Sequence: Synthetic polynucleotide"
gcctccctcgcgccatcaggacactcttggcagttctggcaagctgagtctccctaagtggactcagagagggggtggtgaggactcacctgaggagacggtgaccagggttccctggccccaggggtcgaaccagtcgacgacactcttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggacactcttggcagttctgagcgggctggcaaggc

SEQ ID NO: 2366 - DNA, 495 bp, Artificial Sequence
  source: /note="Description of Artificial Sequence: Synthetic polynucleotide"
gcctccctcgcgccatcaggacactctcagtccaactggcaagctgagtctccctaagtggactcagagagggggtggtgaggactcacctgaggagacggtgaccagggttccctggccccaggggtcgaaccagtcgacgacactctcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgacactctcagtccaactgagcgggctggcaaggc

SEQ ID NO: 2367 - DNA, 495 bp, Artificial Sequence
  source: /note="Description of Artificial Sequence: Synthetic polynucleotide"
gcctccctcgcgccatcaggacactctgtgtctacctggcaagctgagtctccctaagtggactcagagagggggtggtgaggactcacctgaggagacggtgaccagggttccctggccccaggggtcgaaccagtcgacgacactctgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggacactctgtgtctacctgagcgggctggcaaggc

SEQ ID NO: 2368 - DNA, 495 bp, Artificial Sequence
  source: /note="Description of Artificial Sequence: Synthetic polynucleotide"
gcctccctcgcgccatcaggacactctgtacagtgctggcaagctgagtctccctaagtggactcagagagggggtggtgaggactcacctgaggagacggtgaccagggttccctggccccaggggtcgaaccagtcgacgacactctgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggacactctgtacagtgctgagcgggctggcaaggc

SEQ ID NO: 2369 - DNA, 495 bp, Artificial Sequence
  source: /note="Description of Artificial Sequence: Synthetic polynucleotide"
gcctccctcgcgccatcaggacactctggatcatcctggcaagctgagtctccctaagtggactcagagagggggtggtgaggactcacctgaggagacggtgaccagggttccctggccccaggggtcgaaccagtcgacgacactctggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggacactctggatcatcctgagcgggctggcaaggc

SEQ ID NO: 2370 - DNA, 495 bp, Artificial Sequence
  source: /note="Description of Artificial Sequence: Synthetic polynucleotide"
gcctccctcgcgccatcaggacactcttattggcgctggcaagctgagtctccctaagtggactcagagagggggtggtgaggactcacctgaggagacggtgaccagggttccctggccccaggggtcgaaccagtcgacgacactcttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagacactcttattggcgctgagcgggctggcaaggc

SEQ ID NO: 2371 - DNA, 495 bp, Artificial Sequence
  source: /note="Description of Artificial Sequence: Synthetic polynucleotide"
gcctccctcgcgccatcaggacactctaggcttgactggcaagctgagtctccctaagtggactcagagagggggtggtgaggactcacctgaggagacggtgaccagggttccctggccccaggggtcgaaccagtcgacgacactctaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgacactctaggcttgactgagcgggctggcaaggc

SEQ ID NO: 2372 - DNA, 495 bp, Artificial Sequence
  source: /note="Description of Artificial Sequence: Synthetic polynucleotide"
gcctccctcgcgccatcaggacactctacacacgtctggcaagctgagtctccctaagtggactcagagagggggtggtgaggactcacctgaggagacggtgaccagggttccctggccccaggggtcgaaccagtcgacgacactctacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgacactctacacacgtctgagcgggctggcaaggc

SEQ ID NO: 2373 - DNA, 495 bp, Artificial Sequence
  source: /note="Description of Artificial Sequence: Synthetic polynucleotide"
gcctccctcgcgccatcaggacactcttagacggactggcaagctgagtctccctaagtggactcagagagggggtggtgaggactcacctgaggagacggtgaccagggttccctggccccaggggtcgaaccagtcgacgacactcttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagacactcttagacggactgagcgggctggcaaggc

SEQ ID NO: 2374 - DNA, 495 bp, Artificial Sequence
  source: /note="Description of Artificial Sequence: Synthetic polynucleotide"
gcctccctcgcgccatcaggacactctgagcgatactggcaagctgagtctccctaagtggactcagagagggggtggtgaggactcacctgaggagacggtgaccagggttccctggccccaggggtcgaaccagtcgacgacactctgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgacactctgagcgatactgagcgggctggcaaggc

SEQ ID NO: 2375 - DNA, 495 bp, Artificial Sequence
  source: /note="Description of Artificial Sequence: Synthetic polynucleotide"
gcctccctcgcgccatcaggacactctgcatctgactggcaagctgagtctccctaagtggactcagagagggggtggtgaggactcacctgaggagacggtgaccagggttccctggccccaggggtcgaaccagtcgacgacactctgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagacactctgcatctgactgagcgggctggcaaggc

SEQ ID NO: 2376 - DNA, 495 bp, Artificial Sequence
  source: /note="Description of Artificial Sequence: Synthetic polynucleotide"
gcctccctcgcgccatcaggacactcttgctacacctggcaagctgagtctccctaagtggactcagagagggggtggtgaggactcacctgaggagacggtgaccagggttccctggccccaggggtcgaaccagtcgacgacactcttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggacactcttgctacacctgagcgggctggcaaggc

SEQ ID NO: 2377 - DNA, 495 bp, Artificial Sequence
  source: /note="Description of Artificial Sequence: Synthetic polynucleotide"
gcctccctcgcgccatcaggacactctaactgccactggcaagctgagtctccctaagtggactcagagagggggtggtgaggactcacctgaggagacggtgaccagggttccctggccccaggggtcgaaccagtcgacgacactctaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgacactctaactgccactgagcgggctggcaaggc

SEQ ID NO: 2378 - DNA, 495 bp, Artificial Sequence
  source: /note="Description of Artificial Sequence: Synthetic polynucleotide"
gcctccctcgcgccatcaggacactctttggactgctggcaagctgagtctccctaagtggactcagagagggggtggtgaggactcacctgaggagacggtgaccagggttccctggccccaggggtcgaaccagtcgacgacactctttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggacactctttggactgctgagcgggctggcaaggc

SEQ ID NO: 2379 - DNA, 495 bp, Artificial Sequence
  source: /note="Description of Artificial Sequence: Synthetic polynucleotide"
gcctccctcgcgccatcaggacactcttcggtactctggcaagctgagtctccctaagtggactcagagagggggtggtgaggactcacctgaggagacggtgaccagggttccctggccccaggggtcgaaccagtcgacgacactcttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggacactcttcggtactctgagcgggctggcaaggc

SEQ ID NO: 2380 - DNA, 495 bp, Artificial Sequence
  source: /note="Description of Artificial Sequence: Synthetic polynucleotide"
gcctccctcgcgccatcaggacactctccatggatctggcaagctgagtctccctaagtggactcagagagggggtggtgaggactcacctgaggagacggtgaccagggttccctggccccaggggtcgaaccagtcgacgacactctccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgacactctccatggatctgagcgggctggcaaggc

SEQ ID NO: 2381 - DNA, 495 bp, Artificial Sequence
  source: /note="Description of Artificial Sequence: Synthetic polynucleotide"
gcctccctcgcgccatcaggacactctacgaagatctggcaagctgagtctccctaagtggactcagagagggggtggtgaggactcacctgaggagacggtgaccagggttccctggccccaggggtcgaaccagtcgacgacactctacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagacactctacgaagatctgagcgggctggcaaggc

SEQ ID NO: 2382 - DNA, 495 bp, Artificial Sequence
  source: /note="Description of Artificial Sequence: Synthetic polynucleotide"
gcctccctcgcgccatcaggacactctactgtggactggcaagctgagtctccctaagtggactcagagagggggtggtgaggactcacctgaggagacggtgaccagggttccctggccccaggggtcgaaccagtcgacgacactctactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgacactctactgtggactgagcgggctggcaaggc

SEQ ID NO: 2383 - DNA, 495 bp, Artificial Sequence
  source: /note="Description of Artificial Sequence: Synthetic polynucleotide"
gcctccctcgcgccatcaggacactctggtgtcatctggcaagctgagtctccctaagtggactcagagagggggtggtgaggactcacctgaggagacggtgaccagggttccctggccccaggggtcgaaccagtcgacgacactctggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgacactctggtgtcatctgagcgggctggcaaggc

SEQ ID NO: 2384 - DNA, 495 bp, Artificial Sequence
  source: /note="Description of Artificial Sequence: Synthetic polynucleotide"
gcctccctcgcgccatcaggacactcttcgtgaagctggcaagctgagtctccctaagtggactcagagagggggtggtgaggactcacctgaggagacggtgaccagggttccctggccccaggggtcgaaccagtcgacgacactcttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggacactcttcgtgaagctgagcgggctggcaaggc

SEQ ID NO: 2385 - DNA, 495 bp, Artificial Sequence
  source: /note="Description of Artificial Sequence: Synthetic polynucleotide"
gcctccctcgcgccatcaggacactctcactagctctggcaagctgagtctccctaagtggactcagagagggggtggtgaggactcacctgaggagacggtgaccagggttccctggccccaggggtcgaaccagtcgacgacactctcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagacactctcactagctctgagcgggctggcaaggc

SEQ ID NO: 2386 - DNA, 495 bp, Artificial Sequence
  source: /note="Description of Artificial Sequence: Synthetic polynucleotide"
gcctccctcgcgccatcaggacactctggtcaactctggcaagctgagtctccctaagtggactcagagagggggtggtgaggactcacctgaggagacggtgaccagggttccctggccccaggggtcgaaccagtcgacgacactctggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagacactctggtcaactctgagcgggctggcaaggc

SEQ ID NO: 2387 - DNA, 495 bp, Artificial Sequence
  source: /note="Description of Artificial Sequence: Synthetic polynucleotide"
gcctccctcgcgccatcaggacactcttacgtacgctggcaagctgagtctccctaagtggactcagagagggggtggtgaggactcacctgaggagacggtgaccagggttccctggccccaggggtcgaaccagtcgacgacactcttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgacactcttacgtacgctgagcgggctggcaaggc

SEQ ID NO: 2388 - DNA, 495 bp, Artificial Sequence
  source: /note="Description of Artificial Sequence: Synthetic polynucleotide"
gcctccctcgcgccatcaggacactctatgacaccctggcaagctgagtctccctaagtggactcagagagggggtggtgaggactcacctgaggagacggtgaccagggttccctggccccaggggtcgaaccagtcgacgacactctatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggacactctatgacaccctgagcgggctggcaaggc

SEQ ID NO: 2389 - DNA, 495 bp, Artificial Sequence
  source: /note="Description of Artificial Sequence: Synthetic polynucleotide"
gcctccctcgcgccatcaggacactctcttcacgactggcaagctgagtctccctaagtggactcagagagggggtggtgaggactcacctgaggagacggtgaccagggttccctggccccaggggtcgaaccagtcgacgacactctcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgacactctcttcacgactgagcgggctggcaaggc

SEQ ID NO: 2390 - DNA, 495 bp, Artificial Sequence
  source: /note="Description of Artificial Sequence: Synthetic polynucleotide"
gcctccctcgcgccatcaggacactctagaatcagctggcaagctgagtctccctaagtggactcagagagggggtggtgaggactcacctgaggagacggtgaccagggttccctggccccaggggtcgaaccagtcgacgacactctagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgacactctagaatcagctgagcgggctggcaaggc

SEQ ID NO: 2391 - DNA, 495 bp, Artificial Sequence
  source: /note="Description of Artificial Sequence: Synthetic polynucleotide"
gcctccctcgcgccatcaggacactctagttatgcctggcaagctgagtctccctaagtggactcagagagggggtggtgaggactcacctgaggagacggtgaccagggttccctggccccaggggtcgaaccagtcgacgacactctagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagacactctagttatgcctgagcgggctggcaaggc

SEQ ID NO: 2392 - DNA, 495 bp, Artificial Sequence
  source: /note="Description of Artificial Sequence: Synthetic polynucleotide"
gcctccctcgcgccatcaggacactctaggtctcactggcaagctgagtctccctaagtggactcagagagggggtggtgaggactcacctgaggagacggtgaccagggttccctggccccaggggtcgaaccagtcgacgacactctaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgacactctaggtctcactgagcgggctggcaaggc

SEQ ID NO: 2393 - DNA, 495 bp, Artificial Sequence
  source: /note="Description of Artificial Sequence: Synthetic polynucleotide"
gcctccctcgcgccatcaggacactctgtcatagtctggcaagctgagtctccctaagtggactcagagagggggtggtgaggactcacctgaggagacggtgaccagggttccctggccccaggggtcgaaccagtcgacgacactctgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgacactctgtcatagtctgagcgggctggcaaggc

SEQ ID NO: 2394 - DNA, 495 bp, Artificial Sequence
  source: /note="Description of Artificial Sequence: Synthetic polynucleotide"
gcctccctcgcgccatcaggacactctgtgacttgctggcaagctgagtctccctaagtggactcagagagggggtggtgaggactcacctgaggagacggtgaccagggttccctggccccaggggtcgaaccagtcgacgacactctgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggacactctgtgacttgctgagcgggctggcaaggc

SEQ ID NO: 2395 - DNA, 495 bp, Artificial Sequence
  source: /note="Description of Artificial Sequence: Synthetic polynucleotide"
gcctccctcgcgccatcaggacactctgattgcagctggcaagctgagtctccctaagtggactcagagagggggtggtgaggactcacctgaggagacggtgaccagggttccctggccccaggggtcgaaccagtcgacgacactctgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgacactctgattgcagctgagcgggctggcaaggc

SEQ ID NO: 2396 - DNA, 495 bp, Artificial Sequence
  source: /note="Description of Artificial Sequence: Synthetic polynucleotide"
gcctccctcgcgccatcaggacactctactatgacctggcaagctgagtctccctaagtggactcagagagggggtggtgaggactcacctgaggagacggtgaccagggttccctggccccaggggtcgaaccagtcgacgacactctactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgacactctactatgacctgagcgggctggcaaggc

SEQ ID NO: 2397 - DNA, 495 bp, Artificial Sequence
  source: /note="Description of Artificial Sequence: Synthetic polynucleotide"
gcctccctcgcgccatcaggacactctatggtcaactggcaagctgagtctccctaagtggactcagagagggggtggtgaggactcacctgaggagacggtgaccagggttccctggccccaggggtcgaaccagtcgacgacactctatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgacactctatggtcaactgagcgggctggcaaggc

SEQ ID NO: 2398 - DNA, 495 bp, Artificial Sequence
  source: /note="Description of Artificial Sequence: Synthetic polynucleotide"
gcctccctcgcgccatcaggacactctgatggcttctggcaagctgagtctccctaagtggactcagagagggggtggtgaggactcacctgaggagacggtgaccagggttccctggccccaggggtcgaaccagtcgacgacactctgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgacactctgatggcttctgagcgggctggcaaggc

SEQ ID NO: 2399 - DNA, 495 bp, Artificial Sequence
  source: /note="Description of Artificial Sequence: Synthetic polynucleotide"
gcctccctcgcgccatcaggacactctagcatatgctggcaagctgagtctccctaagtggactcagagagggggtggtgaggactcacctgaggagacggtgaccagggttccctggccccaggggtcgaaccagtcgacgacactctagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgacactctagcatatgctgagcgggctggcaaggc

SEQ ID NO: 2400 - DNA, 495 bp, Artificial Sequence
  source: /note="Description of Artificial Sequence: Synthetic polynucleotide"
gcctccctcgcgccatcaggacactctcatatgctctggcaagctgagtctccctaagtggactcagagagggggtggtgaggactcacctgaggagacggtgaccagggttccctggccccaggggtcgaaccagtcgacgacactctcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggacactctcatatgctctgagcgggctggcaaggc

SEQ ID NO: 2401 - DNA, 495 bp, Artificial Sequence
  source: /note="Description of Artificial Sequence: Synthetic polynucleotide"
gcctccctcgcgccatcaggacactcttcgtcgatctggcaagctgagtctccctaagtggactcagagagggggtggtgaggactcacctgaggagacggtgaccagggttccctggccccaggggtcgaaccagtcgacgacactcttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgacactcttcgtcgatctgagcgggctggcaaggc

SEQ ID NO: 2402 - DNA, 495 bp, Artificial Sequence
  source: /note="Description of Artificial Sequence: Synthetic polynucleotide"
gcctccctcgcgccatcaggacactctcagtctgtctggcaagctgagtctccctaagtggactcagagagggggtggtgaggactcacctgaggagacggtgaccagggttccctggccccaggggtcgaaccagtcgacgacactctcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgacactctcagtctgtctgagcgggctggcaaggc

SEQ ID NO: 2403 - DNA, 495 bp, Artificial Sequence
  source: /note="Description of Artificial Sequence: Synthetic polynucleotide"
gcctccctcgcgccatcaggacactctaacgcgtactggcaagctgagtctccctaagtggactcagagagggggtggtgaggactcacctgaggagacggtgaccagggttccctggccccaggggtcgaaccagtcgacgacactctaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggacactctaacgcgtactgagcgggctggcaaggc

SEQ ID NO: 2404 - DNA, 495 bp, Artificial Sequence
  source: /note="Description of Artificial Sequence: Synthetic polynucleotide"
gcctccctcgcgccatcaggacactctgtagttcgctggcaagctgagtctccctaagtggactcagagagggggtggtgaggactcacctgaggagacggtgaccagggttccctggccccaggggtcgaaccagtcgacgacactctgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgacactctgtagttcgctgagcgggctggcaaggc

SEQ ID NO: 2405 - DNA, 495 bp, Artificial Sequence
  source: /note="Description of Artificial Sequence: Synthetic polynucleotide"
gcctccctcgcgccatcaggacactctcgaactacctggcaagctgagtctccctaagtggactcagagagggggtggtgaggactcacctgaggagacggtgaccagggttccctggccccaggggtcgaaccagtcgacgacactctcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgacactctcgaactacctgagcgggctggcaaggc

SEQ ID NO: 2406 - DNA, 495 bp, Artificial Sequence
  source: /note="Description of Artificial Sequence: Synthetic polynucleotide"
gcctccctcgcgccatcaggacactctttaacgtcctggcaagctgagtctccctaagtggactcagagagggggtggtgaggactcacctgaggagacggtgaccagggttccctggccccaggggtcgaaccagtcgacgacactctttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgacactctttaacgtcctgagcgggctggcaaggc

SEQ ID NO: 2407 - DNA, 495 bp, Artificial Sequence
  source: /note="Description of Artificial Sequence: Synthetic polynucleotide"
gcctccctcgcgccatcaggacactctagcaacctctggcaagctgagtctccctaagtggactcagagagggggtggtgaggactcacctgaggagacggtgaccagggttccctggccccaggggtcgaaccagtcgacgacactctagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgacactctagcaacctctgagcgggctggcaaggc

SEQ ID NO: 2408 - DNA, 495 bp, Artificial Sequence
  source: /note="Description of Artificial Sequence: Synthetic polynucleotide"
gcctccctcgcgccatcaggacactctttctcgagctggcaagctgagtctccctaagtggactcagagagggggtggtgaggactcacctgaggagacggtgaccagggttccctggccccaggggtcgaaccagtcgacgacactctttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgacactctttctcgagctgagcgggctggcaaggc

SEQ ID NO: 2409 - DNA, 495 bp, Artificial Sequence
  source: /note="Description of Artificial Sequence: Synthetic polynucleotide"
gcctccctcgcgccatcaggacactctactctacgctggcaagctgagtctccctaagtggactcagagagggggtggtgaggactcacctgaggagacggtgaccagggttccctggccccaggggtcgaaccagtcgacgacactctactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgacactctactctacgctgagcgggctggcaaggc

SEQ ID NO: 2410 - DNA, 495 bp, Artificial Sequence
  source: /note="Description of Artificial Sequence: Synthetic polynucleotide"
gcctccctcgcgccatcaggacactcttaccggaactggcaagctgagtctccctaagtggactcagagagggggtggtgaggactcacctgaggagacggtgaccagggttccctggccccaggggtcgaaccagtcgacgacactcttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgacactcttaccggaactgagcgggctggcaaggc

SEQ ID NO: 2411 - DNA, 495 bp, Artificial Sequence
  source: /note="Description of Artificial Sequence: Synthetic polynucleotide"
gcctccctcgcgccatcaggacactctcgaattgcctggcaagctgagtctccctaagtggactcagagagggggtggtgaggactcacctgaggagacggtgaccagggttccctggccccaggggtcgaaccagtcgacgacactctcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgacactctcgaattgcctgagcgggctggcaaggc

SEQ ID NO: 2412 - DNA, 495 bp, Artificial Sequence
  source: /note="Description of Artificial Sequence: Synthetic polynucleotide"
gcctccctcgcgccatcaggacactctttcgctcactggcaagctgagtctccctaagtggactcagagagggggtggtgaggactcacctgaggagacggtgaccagggttccctggccccaggggtcgaaccagtcgacgacactctttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagacactctttcgctcactgagcgggctggcaaggc

SEQ ID NO: 2413 - DNA, 495 bp, Artificial Sequence
  source: /note="Description of Artificial Sequence: Synthetic polynucleotide"
gcctccctcgcgccatcaggacactctgacgttaactggcaagctgagtctccctaagtggactcagagagggggtggtgaggactcacctgaggagacggtgaccagggttccctggccccaggggtcgaaccagtcgacgacactctgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggacactctgacgttaactgagcgggctggcaaggc

SEQ ID NO: 2414 - DNA, 495 bp, Artificial Sequence
  source: /note="Description of Artificial Sequence: Synthetic polynucleotide"
gcctccctcgcgccatcaggacactctcgtagagtctggcaagctgagtctccctaagtggactcagagagggggtggtgaggactcacctgaggagacggtgaccagggttccctggccccaggggtcgaaccagtcgacgacactctcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgacactctcgtagagtctgagcgggctggcaaggc

SEQ ID NO: 2415 - DNA, 495 bp, Artificial Sequence
  source: /note="Description of Artificial Sequence: Synthetic polynucleotide"
gcctccctcgcgccatcaggacactctttccggtactggcaagctgagtctccctaagtggactcagagagggggtggtgaggactcacctgaggagacggtgaccagggttccctggccccaggggtcgaaccagtcgacgacactctttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgacactctttccggtactgagcgggctggcaaggc

SEQ ID NO: 2416 - DNA, 495 bp, Artificial Sequence
  source: /note="Description of Artificial Sequence: Synthetic polynucleotide"
gcctccctcgcgccatcaggacactctgcaattcgctggcaagctgagtctccctaagtggactcagagagggggtggtgaggactcacctgaggagacggtgaccagggttccctggccccaggggtcgaaccagtcgacgacactctgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgacactctgcaattcgctgagcgggctggcaaggc

SEQ ID NO: 2417 - DNA, 495 bp, Artificial Sequence
  source: /note="Description of Artificial Sequence: Synthetic polynucleotide"
gcctccctcgcgccatcaggacactcttgagcgaactggcaagctgagtctccctaagtggactcagagagggggtggtgaggactcacctgaggagacggtgaccagggttccctggccccaggggtcgaaccagtcgacgacactcttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgacactcttgagcgaactgagcgggctggcaaggc

SEQ ID NO: 2418 - DNA, 495 bp, Artificial Sequence
  source: /note="Description of Artificial Sequence: Synthetic polynucleotide"
gcctccctcgcgccatcaggacactcttactaagcctggcaagctgagtctccctaagtggactcagagagggggtggtgaggactcacctgaggagacggtgaccagggttccctggccccaggggtcgaaccagtcgacgacactcttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgacactcttactaagcctgagcgggctggcaaggc

SEQ ID NO: 2419 - DNA, 495 bp, Artificial Sequence
  source: /note="Description of Artificial Sequence: Synthetic polynucleotide"
gcctccctcgcgccatcaggacactcttggcgtatctggcaagctgagtctccctaagtggactcagagagggggtggtgaggactcacctgaggagacggtgaccagggttccctggccccaggggtcgaaccagtcgacgacactcttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgacactcttggcgtatctgagcgggctggcaaggc

SEQ ID NO: 2420 - DNA, 495 bp, Artificial Sequence
  source: /note="Description of Artificial Sequence: Synthetic polynucleotide"
gcctccctcgcgccatcaggacactctgataaccactggcaagctgagtctccctaagtggactcagagagggggtggtgaggactcacctgaggagacggtgaccagggttccctggccccaggggtcgaaccagtcgacgacactctgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggacactctgataaccactgagcgggctggcaaggc

SEQ ID NO: 2421 - DNA, 495 bp, Artificial Sequence
  source: /note="Description of Artificial Sequence: Synthetic polynucleotide"
gcctccctcgcgccatcaggacactctctagtgaactggcaagctgagtctccctaagtggactcagagagggggtggtgaggactcacctgaggagacggtgaccagggttccctggccccaggggtcgaaccagtcgacgacactctctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggacactctctagtgaactgagcgggctggcaaggc

SEQ ID NO: 2422 - DNA, 495 bp, Artificial Sequence
  source: /note="Description of Artificial Sequence: Synthetic polynucleotide"
gcctccctcgcgccatcaggacactctacgttcacctggcaagctgagtctccctaagtggactcagagagggggtggtgaggactcacctgaggagacggtgaccagggttccctggccccaggggtcgaaccagtcgacgacactctacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgacactctacgttcacctgagcgggctggcaaggc

SEQ ID NO: 2423 - DNA, 448 bp, Artificial Sequence
  source: /note="Description of Artificial Sequence: Synthetic polynucleotide"
gcctccctcgcgccatcaggacactctattacgctctggcaagctgagtctccctaagtggactcagagagggggtggtgaggactcacctgaggagacggtgaccagggttccctggccccaggggtcgaaccagtcgacgacactctattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagacactctattacgctctgagcgggctggcaaggc

SEQ ID NO: 2424 - DNA, 495 bp, Artificial Sequence
  source: /note="Description of Artificial Sequence: Synthetic polynucleotide"
gcctccctcgcgccatcaggacactctcattgagtctggcaagctgagtctccctaagtggactcagagagggggtggtgaggactcacctgaggagacggtgaccagggttccctggccccaggggtcgaaccagtcgacgacactctcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgacactctcattgagtctgagcgggctggcaaggc

SEQ ID NO: 2425 - DNA, 495 bp, Artificial Sequence
  source: /note="Description of Artificial Sequence: Synthetic polynucleotide"
gcctccctcgcgccatcagttcggaaccttggttaggcagtagcagaaaacaaaggccctagagtggccattcttacctgaggagacggtgaccgtggtccctttgccccagacgtccatgtagtagtagtagtagtcgacttcggaaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccttcggaaccttggttactgagcgggctggcaaggc

SEQ ID NO: 2426 - DNA, 495 bp, Artificial Sequence
  source: /note="Description of Artificial Sequence: Synthetic polynucleotide"
gcctccctcgcgccatcagttcggaacacctcttgggcagtagcagaaaacaaaggccctagagtggccattcttacctgaggagacggtgaccgtggtccctttgccccagacgtccatgtagtagtagtagtagtcgacttcggaacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccttcggaacacctcttgctgagcgggctggcaaggc

SEQ ID NO: 2427 - DNA, 495 bp, Artificial Sequence
  source: /note="Description of Artificial Sequence: Synthetic polynucleotide"
gcctccctcgcgccatcagttcggaacctgattctggcagtagcagaaaacaaaggccctagagtggccattcttacctgaggagacggtgaccgtggtccctttgccccagacgtccatgtagtagtagtagtagtcgacttcggaacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccttcggaacctgattctctgagcgggctggcaaggc

SEQ ID NO: 2428 - DNA, 495 bp, Artificial Sequence
  source: /note="Description of Artificial Sequence: Synthetic polynucleotide"
gcctccctcgcgccatcagttcggaacagtaccgaggcagtagcagaaaacaaaggccctagagtggccattcttacctgaggagacggtgaccgtggtccctttgccccagacgtccatgtagtagtagtagtagtcgacttcggaacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccttcggaacagtaccgactgagcgggctggcaaggc

SEQ ID NO: 2429 - DNA, 495 bp, Artificial Sequence
  source: /note="Description of Artificial Sequence: Synthetic polynucleotide"
gcctccctcgcgccatcagttcggaacatccatggggcagtagcagaaaacaaaggccctagagtggccattcttacctgaggagacggtgaccgtggtccctttgccccagacgtccatgtagtagtagtagtagtcgacttcggaacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccttcggaacatccatggctgagcgggctggcaaggc

SEQ ID NO: 2430 - DNA, 495 bp, Artificial Sequence
  source: /note="Description of Artificial Sequence: Synthetic polynucleotide"
gcctccctcgcgccatcagttcggaacgtagcagtggcagtagcagaaaacaaaggccctagagtggccattcttacctgaggagacggtgaccgtggtccctttgccccagacgtccatgtagtagtagtagtagtcgacttcggaacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcttcggaacgtagcagtctgagcgggctggcaaggc

SEQ ID NO: 2431 - DNA, 495 bp, Artificial Sequence
  source: /note="Description of Artificial Sequence: Synthetic polynucleotide"
gcctccctcgcgccatcagttcggaacatcttcgtggcagtagcagaaaacaaaggccctagagtggccattcttacctgaggagacggtgaccgtggtccctttgccccagacgtccatgtagtagtagtagtagtcgacttcggaacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccttcggaacatcttcgtctgagcgggctggcaaggc

SEQ ID NO: 2432 - DNA, 495 bp, Artificial Sequence
  source: /note="Description of Artificial Sequence: Synthetic polynucleotide"
gcctccctcgcgccatcagttcggaactccacagtggcagtagcagaaaacaaaggccctagagtggccattcttacctgaggagacggtgaccgtggtccctttgccccagacgtccatgtagtagtagtagtagtcgacttcggaactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccttcggaactccacagtctgagcgggctggcaaggc

SEQ ID NO: 2433 - DNA, 495 bp, Artificial Sequence
  source: /note="Description of Artificial Sequence: Synthetic polynucleotide"
gcctccctcgcgccatcagttcggaacagctagtgggcagtagcagaaaacaaaggccctagagtggccattcttacctgaggagacggtgaccgtggtccctttgccccagacgtccatgtagtagtagtagtagtcgacttcggaacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccttcggaacagctagtgctgagcgggctggcaaggc

SEQ ID NO: 2434 - DNA, 495 bp, Artificial Sequence
  source: /note="Description of Artificial Sequence: Synthetic polynucleotide"
gcctccctcgcgccatcagttcggaactaaccaagggcagtagcagaaaacaaaggccctagagtggccattcttacctgaggagacggtgaccgtggtccctttgccccagacgtccatgtagtagtagtagtagtcgacttcggaactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccttcggaactaaccaagctgagcgggctggcaaggc

SEQ ID NO: 2435 - DNA, 495 bp, Artificial Sequence
  source: /note="Description of Artificial Sequence: Synthetic polynucleotide"
gcctccctcgcgccatcagttcggaaccaagaggtggcagtagcagaaaacaaaggccctagagtggccattcttacctgaggagacggtgaccgtggtccctttgccccagacgtccatgtagtagtagtagtagtcgacttcggaaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccttcggaaccaagaggtctgagcgggctggcaaggc

SEQ ID NO: 2436 - DNA, 495 bp, Artificial Sequence
  source: /note="Description of Artificial Sequence: Synthetic polynucleotide"
gcctccctcgcgccatcagttcggaacagttgaccggcagtagcagaaaacaaaggccctagagtggccattcttacctgaggagacggtgaccgtggtccctttgccccagacgtccatgtagtagtagtagtagtcgacttcggaacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaattcggaacagttgaccctgagcgggctggcaaggc

SEQ ID NO: 2437 - DNA, 495 bp, Artificial Sequence
  source: /note="Description of Artificial Sequence: Synthetic polynucleotide"
gcctccctcgcgccatcagttcggaaccagcatatggcagtagcagaaaacaaaggccctagagtggccattcttacctgaggagacggtgaccgtggtccctttgccccagacgtccatgtagtagtagtagtagtcgacttcggaaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaattcggaaccagcatatctgagcgggctggcaaggc

SEQ ID NO: 2438 - DNA, 495 bp, Artificial Sequence
  source: /note="Description of Artificial Sequence: Synthetic polynucleotide"
gcctccctcgcgccatcagttcggaacgcaggattggcagtagcagaaaacaaaggccctagagtggccattcttacctgaggagacggtgaccgtggtccctttgccccagacgtccatgtagtagtagtagtagtcgacttcggaacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataattcggaacgcaggattctgagcgggctggcaaggc

SEQ ID NO: 2439 - DNA, 495 bp, Artificial Sequence
  source: /note="Description of Artificial Sequence: Synthetic polynucleotide"
gcctccctcgcgccatcagttcggaacgtccattcggcagtagcagaaaacaaaggccctagagtggccattcttacctgaggagacggtgaccgtggtccctttgccccagacgtccatgtagtagtagtagtagtcgacttcggaacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccttcggaacgtccattcctgagcgggctggcaaggc

SEQ ID NO: 2440 - DNA, 495 bp, Artificial Sequence
  source: /note="Description of Artificial Sequence: Synthetic polynucleotide"
gcctccctcgcgccatcagttcggaacgcataactggcagtagcagaaaacaaaggccctagagtggccattcttacctgaggagacggtgaccgtggtccctttgccccagacgtccatgtagtagtagtagtagtcgacttcggaacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacttcggaacgcataactctgagcgggctggcaaggc

SEQ ID NO: 2441 - DNA, 495 bp, Artificial Sequence
  source: /note="Description of Artificial Sequence: Synthetic polynucleotide"
gcctccctcgcgccatcagttcggaacatatgctgggcagtagcagaaaacaaaggccctagagtggccattcttacctgaggagacggtgaccgtggtccctttgccccagacgtccatgtagtagtagtagtagtcgacttcggaacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccttcggaacatatgctgctgagcgggctggcaaggc

SEQ ID NO: 2442 - DNA, 495 bp, Artificial Sequence
  source: /note="Description of Artificial Sequence: Synthetic polynucleotide"
gcctccctcgcgccatcagttcggaacaatcctgcggcagtagcagaaaacaaaggccctagagtggccattcttacctgaggagacggtgaccgtggtccctttgccccagacgtccatgtagtagtagtagtagtcgacttcggaacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcttcggaacaatcctgcctgagcgggctggcaaggc

SEQ ID NO: 2443 - DNA, 495 bp, Artificial Sequence
  source: /note="Description of Artificial Sequence: Synthetic polynucleotide"
gcctccctcgcgccatcagttcggaactgagacctggcagtagcagaaaacaaaggccctagagtggccattcttacctgaggagacggtgaccgtggtccctttgccccagacgtccatgtagtagtagtagtagtcgacttcggaactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgttcggaactgagacctctgagcgggctggcaaggc

SEQ ID NO: 2444 - DNA, 495 bp, Artificial Sequence
  source: /note="Description of Artificial Sequence: Synthetic polynucleotide"
gcctccctcgcgccatcagttcggaacgaatggacggcagtagcagaaaacaaaggccctagagtggccattcttacctgaggagacggtgaccgtggtccctttgccccagacgtccatgtagtagtagtagtagtcgacttcggaacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccttcggaacgaatggacctgagcgggctggcaaggc

SEQ ID NO: 2445 - DNA, 495 bp, Artificial Sequence
  source: /note="Description of Artificial Sequence: Synthetic polynucleotide"
gcctccctcgcgccatcagttcggaaccacatggaggcagtagcagaaaacaaaggccctagagtggccattcttacctgaggagacggtgaccgtggtccctttgccccagacgtccatgtagtagtagtagtagtcgacttcggaaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccttcggaaccacatggactgagcgggctggcaaggc

SEQ ID NO: 2446 - DNA, 495 bp, Artificial Sequence
  source: /note="Description of Artificial Sequence: Synthetic polynucleotide"
gcctccctcgcgccatcagttcggaacttgaccatggcagtagcagaaaacaaaggccctagagtggccattcttacctgaggagacggtgaccgtggtccctttgccccagacgtccatgtagtagtagtagtagtcgacttcggaacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccttcggaacttgaccatctgagcgggctggcaaggc

SEQ ID NO: 2447 - DNA, 495 bp, Artificial Sequence
  source: /note="Description of Artificial Sequence: Synthetic polynucleotide"
gcctccctcgcgccatcagttcggaacaagccatcggcagtagcagaaaacaaaggccctagagtggccattcttacctgaggagacggtgaccgtggtccctttgccccagacgtccatgtagtagtagtagtagtcgacttcggaacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccttcggaacaagccatcctgagcgggctggcaaggc

SEQ ID NO: 2448 - DNA, 495 bp, Artificial Sequence
  source: /note="Description of Artificial Sequence: Synthetic polynucleotide"
gcctccctcgcgccatcagttcggaactccatgtgggcagtagcagaaaacaaaggccctagagtggccattcttacctgaggagacggtgaccgtggtccctttgccccagacgtccatgtagtagtagtagtagtcgacttcggaactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaactccatgtgctgagcgggctggcaaggc

SEQ ID NO: 2449 - DNA, 495 bp, Artificial Sequence
  source: /note="Description of Artificial Sequence: Synthetic polynucleotide"
gcctccctcgcgccatcagttcggaaccaagtcacggcagtagcagaaaacaaaggccctagagtggccattcttacctgaggagacggtgaccgtggtccctttgccccagacgtccatgtagtagtagtagtagtcgacttcggaaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaaccaagtcacctgagcgggctggcaaggc

SEQ ID NO: 2450 - DNA, 495 bp, Artificial Sequence
  source: /note="Description of Artificial Sequence: Synthetic polynucleotide"
gcctccctcgcgccatcagttcggaacctgcaatcggcagtagcagaaaacaaaggccctagagtggccattcttacctgaggagacggtgaccgtggtccctttgccccagacgtccatgtagtagtagtagtagtcgacttcggaacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccttcggaacctgcaatcctgagcgggctggcaaggc

SEQ ID NO: 2451 - DNA, 495 bp, Artificial Sequence
  source: /note="Description of Artificial Sequence: Synthetic polynucleotide"
gcctccctcgcgccatcagttcggaacatcgacgaggcagtagcagaaaacaaaggccctagagtggccattcttacctgaggagacggtgaccgtggtccctttgccccagacgtccatgtagtagtagtagtagtcgacttcggaacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccttcggaacatcgacgactgagcgggctggcaaggc

SEQ ID NO: 2452 - DNA, 495 bp, Artificial Sequence
  source: /note="Description of Artificial Sequence: Synthetic polynucleotide"
gcctccctcgcgccatcagttcggaacacagactgggcagtagcagaaaacaaaggccctagagtggccattcttacctgaggagacggtgaccgtggtccctttgccccagacgtccatgtagtagtagtagtagtcgacttcggaacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaattcggaacacagactgctgagcgggctggcaaggc

SEQ ID NO: 2453 - DNA, 495 bp, Artificial Sequence
  source: /note="Description of Artificial Sequence: Synthetic polynucleotide"
gcctccctcgcgccatcagttcggaacccttatagggcagtagcagaaaacaaaggccctagagtggccattcttacctgaggagacggtgaccgtggtccctttgccccagacgtccatgtagtagtagtagtagtcgacttcggaacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacttcggaacccttatagctgagcgggctggcaaggc

SEQ ID NO: 2454 - DNA, 495 bp, Artificial Sequence
  source: /note="Description of Artificial Sequence: Synthetic polynucleotide"
gcctccctcgcgccatcagttcggaactacgcgttggcagtagcagaaaacaaaggccctagagtggccattcttacctgaggagacggtgaccgtggtccctttgccccagacgtccatgtagtagtagtagtagtcgacttcggaactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccttcggaactacgcgttctgagcgggctggcaaggc

SEQ ID NO: 2455 - DNA, 495 bp, Artificial Sequence
  source: /note="Description of Artificial Sequence: Synthetic polynucleotide"
gcctccctcgcgccatcagttcggaacctataaggggcagtagcagaaaacaaaggccctagagtggccattcttacctgaggagacggtgaccgtggtccctttgccccagacgtccatgtagtagtagtagtagtcgacttcggaacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgttcggaacctataaggctgagcgggctggcaaggc

SEQ ID NO: 2456 - DNA, 495 bp, Artificial Sequence
  source: /note="Description of Artificial Sequence: Synthetic polynucleotide"
gcctccctcgcgccatcagttcggaactcttagtcggcagtagcagaaaacaaaggccctagagtggccattcttacctgaggagacggtgaccgtggtccctttgccccagacgtccatgtagtagtagtagtagtcgacttcggaactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaactcttagtcctgagcgggctggcaaggc

SEQ ID NO: 2457 - DNA, 495 bp, Artificial Sequence
  source: /note="Description of Artificial Sequence: Synthetic polynucleotide"
gcctccctcgcgccatcagttcggaactgtctgcaggcagtagcagaaaacaaaggccctagagtggccattcttacctgaggagacggtgaccgtggtccctttgccccagacgtccatgtagtagtagtagtagtcgacttcggaactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccttcggaactgtctgcactgagcgggctggcaaggc

SEQ ID NO: 2458 - DNA, 495 bp, Artificial Sequence
  source: /note="Description of Artificial Sequence: Synthetic polynucleotide"
gcctccctcgcgccatcagttcggaacgccattaaggcagtagcagaaaacaaaggccctagagtggccattcttacctgaggagacggtgaccgtggtccctttgccccagacgtccatgtagtagtagtagtagtcgacttcggaacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaacgccattaactgagcgggctggcaaggc

SEQ ID NO: 2459 - DNA, 495 bp, Artificial Sequence
  source: /note="Description of Artificial Sequence: Synthetic polynucleotide"
gcctccctcgcgccatcagttcggaacgactaagaggcagtagcagaaaacaaaggccctagagtggccattcttacctgaggagacggtgaccgtggtccctttgccccagacgtccatgtagtagtagtagtagtcgacttcggaacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgttcggaacgactaagactgagcgggctggcaaggc

SEQ ID NO: 2460 - DNA, 495 bp, Artificial Sequence
  source: /note="Description of Artificial Sequence: Synthetic polynucleotide"
gcctccctcgcgccatcagttcggaacaggttgctggcagtagcagaaaacaaaggccctagagtggccattcttacctgaggagacggtgaccgtggtccctttgccccagacgtccatgtagtagtagtagtagtcgacttcggaacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgttcggaacaggttgctctgagcgggctggcaaggc

SEQ ID NO: 2461 - DNA, 495 bp, Artificial Sequence
  source: /note="Description of Artificial Sequence: Synthetic polynucleotide"
gcctccctcgcgccatcagttcggaacctcgagaaggcagtagcagaaaacaaaggccctagagtggccattcttacctgaggagacggtgaccgtggtccctttgccccagacgtccatgtagtagtagtagtagtcgacttcggaacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccttcggaacctcgagaactgagcgggctggcaaggc

SEQ ID NO: 2462 - DNA, 495 bp, Artificial Sequence
  source: /note="Description of Artificial Sequence: Synthetic polynucleotide"
gcctccctcgcgccatcagttcggaacttaatggcggcagtagcagaaaacaaaggccctagagtggccattcttacctgaggagacggtgaccgtggtccctttgccccagacgtccatgtagtagtagtagtagtcgacttcggaacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccttcggaacttaatggcctgagcgggctggcaaggc

SEQ ID NO: 2463 - DNA, 495 bp, Artificial Sequence
  source: /note="Description of Artificial Sequence: Synthetic polynucleotide"
gcctccctcgcgccatcagttcggaactgcagacaggcagtagcagaaaacaaaggccctagagtggccattcttacctgaggagacggtgaccgtggtccctttgccccagacgtccatgtagtagtagtagtagtcgacttcggaactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaattcggaactgcagacactgagcgggctggcaaggc

SEQ ID NO: 2464 - DNA, 495 bp, Artificial Sequence
  source: /note="Description of Artificial Sequence: Synthetic polynucleotide"
gcctccctcgcgccatcagttcggaactcactgagggcagtagcagaaaacaaaggccctagagtggccattcttacctgaggagacggtgaccgtggtccctttgccccagacgtccatgtagtagtagtagtagtcgacttcggaactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtttcggaactcactgagctgagcgggctggcaaggc

SEQ ID NO: 2465 - DNA, 495 bp, Artificial Sequence
  source: /note="Description of Artificial Sequence: Synthetic polynucleotide"
gcctccctcgcgccatcagttcggaacgagtacgtggcagtagcagaaaacaaaggccctagagtggccattcttacctgaggagacggtgaccgtggtccctttgccccagacgtccatgtagtagtagtagtagtcgacttcggaacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacttcggaacgagtacgtctgagcgggctggcaaggc

SEQ ID NO: 2466 - DNA, 495 bp, Artificial Sequence
  source: /note="Description of Artificial Sequence: Synthetic polynucleotide"
gcctccctcgcgccatcagttcggaacatacgccaggcagtagcagaaaacaaaggccctagagtggccattcttacctgaggagacggtgaccgtggtccctttgccccagacgtccatgtagtagtagtagtagtcgacttcggaacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacttcggaacatacgccactgagcgggctggcaaggc

SEQ ID NO: 2467 - DNA, 495 bp, Artificial Sequence
  source: /note="Description of Artificial Sequence: Synthetic polynucleotide"
gcctccctcgcgccatcagttcggaactcgcatcaggcagtagcagaaaacaaaggccctagagtggccattcttacctgaggagacggtgaccgtggtccctttgccccagacgtccatgtagtagtagtagtagtcgacttcggaactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacttcggaactcgcatcactgagcgggctggcaaggc

SEQ ID NO: 2468 - DNA, 495 bp, Artificial Sequence
  source: /note="Description of Artificial Sequence: Synthetic polynucleotide"
gcctccctcgcgccatcagttcggaaccgcttaatggcagtagcagaaaacaaaggccctagagtggccattcttacctgaggagacggtgaccgtggtccctttgccccagacgtccatgtagtagtagtagtagtcgacttcggaaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacttcggaaccgcttaatctgagcgggctggcaaggc

SEQ ID NO: 2469 - DNA, 495 bp, Artificial Sequence
  source: /note="Description of Artificial Sequence: Synthetic polynucleotide"
gcctccctcgcgccatcagttcggaactggttatcggcagtagcagaaaacaaaggccctagagtggccattcttacctgaggagacggtgaccgtggtccctttgccccagacgtccatgtagtagtagtagtagtcgacttcggaactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtttcggaactggttatcctgagcgggctggcaaggc

SEQ ID NO: 2470 - DNA, 495 bp, Artificial Sequence
  source: /note="Description of Artificial Sequence: Synthetic polynucleotide"
gcctccctcgcgccatcagttcggaacggattgctggcagtagcagaaaacaaaggccctagagtggccattcttacctgaggagacggtgaccgtggtccctttgccccagacgtccatgtagtagtagtagtagtcgacttcggaacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacttcggaacggattgctctgagcgggctggcaaggc

SEQ ID NO: 2471 - DNA, 495 bp, Artificial Sequence
  source: /note="Description of Artificial Sequence: Synthetic polynucleotide"
gcctccctcgcgccatcagttcggaacctcagtgaggcagtagcagaaaacaaaggccctagagtggccattcttacctgaggagacggtgaccgtggtccctttgccccagacgtccatgtagtagtagtagtagtcgacttcggaacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtttcggaacctcagtgactgagcgggctggcaaggc

SEQ ID NO: 2472 - DNA, 495 bp, Artificial Sequence
  source: /note="Description of Artificial Sequence: Synthetic polynucleotide"
gcctccctcgcgccatcagttcggaacacgtactcggcagtagcagaaaacaaaggccctagagtggccattcttacctgaggagacggtgaccgtggtccctttgccccagacgtccatgtagtagtagtagtagtcgacttcggaacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacttcggaacacgtactcctgagcgggctggcaaggc

SEQ ID NO: 2473 - DNA, 495 bp, Artificial Sequence
  source: /note="Description of Artificial Sequence: Synthetic polynucleotide"
gcctccctcgcgccatcagttcggaactgatgcgaggcagtagcagaaaacaaaggccctagagtggccattcttacctgaggagacggtgaccgtggtccctttgccccagacgtccatgtagtagtagtagtagtcgacttcggaactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccttcggaactgatgcgactgagcgggctggcaaggc

SEQ ID NO: 2474 - DNA, 495 bp, Artificial Sequence
  source: /note="Description of Artificial Sequence: Synthetic polynucleotide"
gcctccctcgcgccatcagttcggaacattaagcgggcagtagcagaaaacaaaggccctagagtggccattcttacctgaggagacggtgaccgtggtccctttgccccagacgtccatgtagtagtagtagtagtcgacttcggaacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccttcggaacattaagcgctgagcgggctggcaaggc

SEQ ID NO: 2475 - DNA, 495 bp, Artificial Sequence
  source: /note="Description of Artificial Sequence: Synthetic polynucleotide"
gcctccctcgcgccatcagttcggaacagcaatccggcagtagcagaaaacaaaggccctagagtggccattcttacctgaggagacggtgaccgtggtccctttgccccagacgtccatgtagtagtagtagtagtcgacttcggaacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccttcggaacagcaatccctgagcgggctggcaaggc

SEQ ID NO: 2476 - DNA, 495 bp, Artificial Sequence
  source: /note="Description of Artificial Sequence: Synthetic polynucleotide"
gcctccctcgcgccatcagttcggaacgcttagtaggcagtagcagaaaacaaaggccctagagtggccattcttacctgaggagacggtgaccgtggtccctttgccccagacgtccatgtagtagtagtagtagtcgacttcggaacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgattcggaacgcttagtactgagcgggctggcaaggc

SEQ ID NO: 2477 - DNA, 495 bp, Artificial Sequence
  source: /note="Description of Artificial Sequence: Synthetic polynucleotide"
gcctccctcgcgccatcagttcggaactgaccttgggcagtagcagaaaacaaaggccctagagtggccattcttacctgaggagacggtgaccgtggtccctttgccccagacgtccatgtagtagtagtagtagtcgacttcggaactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccttcggaactgaccttgctgagcgggctggcaaggc

SEQ ID NO: 2478 - DNA, 495 bp, Artificial Sequence
  source: /note="Description of Artificial Sequence: Synthetic polynucleotide"
gcctccctcgcgccatcagttcggaaccaaggtcaggcagtagcagaaaacaaaggccctagagtggccattcttacctgaggagacggtgaccgtggtccctttgccccagacgtccatgtagtagtagtagtagtcgacttcggaaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccttcggaaccaaggtcactgagcgggctggcaaggc

SEQ ID NO: 2479 - DNA, 495 bp, Artificial Sequence
  source: /note="Description of Artificial Sequence: Synthetic polynucleotide"
gcctccctcgcgccatcagttcggaaccactgtacggcagtagcagaaaacaaaggccctagagtggccattcttacctgaggagacggtgaccgtggtccctttgccccagacgtccatgtagtagtagtagtagtcgacttcggaaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcttcggaaccactgtacctgagcgggctggcaaggc

SEQ ID NO: 2480 - DNA, 495 bp, Artificial Sequence
  source: /note="Description of Artificial Sequence: Synthetic polynucleotide"
gcctccctcgcgccatcagttcggaacgatgatccggcagtagcagaaaacaaaggccctagagtggccattcttacctgaggagacggtgaccgtggtccctttgccccagacgtccatgtagtagtagtagtagtcgacttcggaacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggttcggaacgatgatccctgagcgggctggcaaggc

SEQ ID NO: 2481 - DNA, 495 bp, Artificial Sequence
  source: /note="Description of Artificial Sequence: Synthetic polynucleotide"
gcctccctcgcgccatcagttcggaaccgccaataggcagtagcagaaaacaaaggccctagagtggccattcttacctgaggagacggtgaccgtggtccctttgccccagacgtccatgtagtagtagtagtagtcgacttcggaaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggttcggaaccgccaatactgagcgggctggcaaggc

SEQ ID NO: 2482 - DNA, 495 bp, Artificial Sequence
  source: /note="Description of Artificial Sequence: Synthetic polynucleotide"
gcctccctcgcgccatcagttcggaactcaagcctggcagtagcagaaaacaaaggccctagagtggccattcttacctgaggagacggtgaccgtggtccctttgccccagacgtccatgtagtagtagtagtagtcgacttcggaactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacattcggaactcaagcctctgagcgggctggcaaggc

SEQ ID NO: 2483 - DNA, 495 bp, Artificial Sequence
  source: /note="Description of Artificial Sequence: Synthetic polynucleotide"
gcctccctcgcgccatcagttcggaacacgtgtgtggcagtagcagaaaacaaaggccctagagtggccattcttacctgaggagacggtgaccgtggtccctttgccccagacgtccatgtagtagtagtagtagtcgacttcggaacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagttcggaacacgtgtgtctgagcgggctggcaaggc

SEQ ID NO: 2484 - DNA, 495 bp, Artificial Sequence
  source: /note="Description of Artificial Sequence: Synthetic polynucleotide"
gcctccctcgcgccatcagttcggaactccgtctaggcagtagcagaaaacaaaggccctagagtggccattcttacctgaggagacggtgaccgtggtccctttgccccagacgtccatgtagtagtagtagtagtcgacttcggaactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagttcggaactccgtctactgagcgggctggcaaggc

SEQ ID NO: 2485 - DNA, 495 bp, Artificial Sequence
  source: /note="Description of Artificial Sequence: Synthetic polynucleotide"
gcctccctcgcgccatcagttcggaacaagagctgggcagtagcagaaaacaaaggccctagagtggccattcttacctgaggagacggtgaccgtggtccctttgccccagacgtccatgtagtagtagtagtagtcgacttcggaacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgttcggaacaagagctgctgagcgggctggcaaggc

SEQ ID NO: 2486 - DNA, 495 bp, Artificial Sequence
  source: /note="Description of Artificial Sequence: Synthetic polynucleotide"
gcctccctcgcgccatcagttcggaactatcgctcggcagtagcagaaaacaaaggccctagagtggccattcttacctgaggagacggtgaccgtggtccctttgccccagacgtccatgtagtagtagtagtagtcgacttcggaactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagttcggaactatcgctcctgagcgggctggcaaggc

SEQ ID NO: 2487 - DNA, 495 bp, Artificial Sequence
  source: /note="Description of Artificial Sequence: Synthetic polynucleotide"
gcctccctcgcgccatcagttcggaactcagatgcggcagtagcagaaaacaaaggccctagagtggccattcttacctgaggagacggtgaccgtggtccctttgccccagacgtccatgtagtagtagtagtagtcgacttcggaactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccttcggaactcagatgcctgagcgggctggcaaggc

SEQ ID NO: 2488 - DNA, 495 bp, Artificial Sequence
  source: /note="Description of Artificial Sequence: Synthetic polynucleotide"
gcctccctcgcgccatcagttcggaacgtgtagcaggcagtagcagaaaacaaaggccctagagtggccattcttacctgaggagacggtgaccgtggtccctttgccccagacgtccatgtagtagtagtagtagtcgacttcggaacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgttcggaacgtgtagcactgagcgggctggcaaggc

SEQ ID NO: 2489 - DNA, 495 bp, Artificial Sequence
  source: /note="Description of Artificial Sequence: Synthetic polynucleotide"
gcctccctcgcgccatcagttcggaactggcagttggcagtagcagaaaacaaaggccctagagtggccattcttacctgaggagacggtgaccgtggtccctttgccccagacgtccatgtagtagtagtagtagtcgacttcggaactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgttcggaactggcagttctgagcgggctggcaaggc

SEQ ID NO: 2490 - DNA, 495 bp, Artificial Sequence
  source: /note="Description of Artificial Sequence: Synthetic polynucleotide"
gcctccctcgcgccatcagttcggaaccagtccaaggcagtagcagaaaacaaaggccctagagtggccattcttacctgaggagacggtgaccgtggtccctttgccccagacgtccatgtagtagtagtagtagtcgacttcggaaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacttcggaaccagtccaactgagcgggctggcaaggc

SEQ ID NO: 2491 - DNA, 495 bp, Artificial Sequence
  source: /note="Description of Artificial Sequence: Synthetic polynucleotide"
gcctccctcgcgccatcagttcggaacgtgtctacggcagtagcagaaaacaaaggccctagagtggccattcttacctgaggagacggtgaccgtggtccctttgccccagacgtccatgtagtagtagtagtagtcgacttcggaacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggttcggaacgtgtctacctgagcgggctggcaaggc

SEQ ID NO: 2492 - DNA, 495 bp, Artificial Sequence
  source: /note="Description of Artificial Sequence: Synthetic polynucleotide"
gcctccctcgcgccatcagttcggaacgtacagtgggcagtagcagaaaacaaaggccctagagtggccattcttacctgaggagacggtgaccgtggtccctttgccccagacgtccatgtagtagtagtagtagtcgacttcggaacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagttcggaacgtacagtgctgagcgggctggcaaggc

SEQ ID NO: 2493 - DNA, 495 bp, Artificial Sequence
  source: /note="Description of Artificial Sequence: Synthetic polynucleotide"
gcctccctcgcgccatcagttcggaacggatcatcggcagtagcagaaaacaaaggccctagagtggccattcttacctgaggagacggtgaccgtggtccctttgccccagacgtccatgtagtagtagtagtagtcgacttcggaacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagttcggaacggatcatcctgagcgggctggcaaggc

SEQ ID NO: 2494 - DNA, 495 bp, Artificial Sequence
  source: /note="Description of Artificial Sequence: Synthetic polynucleotide"
gcctccctcgcgccatcagttcggaactattggcgggcagtagcagaaaacaaaggccctagagtggccattcttacctgaggagacggtgaccgtggtccctttgccccagacgtccatgtagtagtagtagtagtcgacttcggaactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcattcggaactattggcgctgagcgggctggcaaggc

SEQ ID NO: 2495 - DNA, 495 bp, Artificial Sequence
  source: /note="Description of Artificial Sequence: Synthetic polynucleotide"
gcctccctcgcgccatcagttcggaacaggcttgaggcagtagcagaaaacaaaggccctagagtggccattcttacctgaggagacggtgaccgtggtccctttgccccagacgtccatgtagtagtagtagtagtcgacttcggaacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacttcggaacaggcttgactgagcgggctggcaaggc

SEQ ID NO: 2496 - DNA, 495 bp, Artificial Sequence
  source: /note="Description of Artificial Sequence: Synthetic polynucleotide"
gcctccctcgcgccatcagttcggaacacacacgtggcagtagcagaaaacaaaggccctagagtggccattcttacctgaggagacggtgaccgtggtccctttgccccagacgtccatgtagtagtagtagtagtcgacttcggaacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatttcggaacacacacgtctgagcgggctggcaaggc

SEQ ID NO: 2497 - DNA, 495 bp, Artificial Sequence
  source: /note="Description of Artificial Sequence: Synthetic polynucleotide"
gcctccctcgcgccatcagttcggaactagacggaggcagtagcagaaaacaaaggccctagagtggccattcttacctgaggagacggtgaccgtggtccctttgccccagacgtccatgtagtagtagtagtagtcgacttcggaactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgattcggaactagacggactgagcgggctggcaaggc

SEQ ID NO: 2498 - DNA, 495 bp, Artificial Sequence
  source: /note="Description of Artificial Sequence: Synthetic polynucleotide"
gcctccctcgcgccatcagttcggaacgagcgataggcagtagcagaaaacaaaggccctagagtggccattcttacctgaggagacggtgaccgtggtccctttgccccagacgtccatgtagtagtagtagtagtcgacttcggaacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttttcggaacgagcgatactgagcgggctggcaaggc

SEQ ID NO: 2499 - DNA, 495 bp, Artificial Sequence
  source: /note="Description of Artificial Sequence: Synthetic polynucleotide"
gcctccctcgcgccatcagttcggaacgcatctgaggcagtagcagaaaacaaaggccctagagtggccattcttacctgaggagacggtgaccgtggtccctttgccccagacgtccatgtagtagtagtagtagtcgacttcggaacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacattcggaacgcatctgactgagcgggctggcaaggc

SEQ ID NO: 2500 - DNA, 495 bp, Artificial Sequence
  source: /note="Description of Artificial Sequence: Synthetic polynucleotide"
gcctccctcgcgccatcagttcggaactgctacacggcagtagcagaaaacaaaggccctagagtggccattcttacctgaggagacggtgaccgtggtccctttgccccagacgtccatgtagtagtagtagtagtcgacttcggaactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgttcggaactgctacacctgagcgggctggcaaggc

SEQ ID NO: 2501 - DNA, 495 bp, Artificial Sequence
  source: /note="Description of Artificial Sequence: Synthetic polynucleotide"
gcctccctcgcgccatcagttcggaacaactgccaggcagtagcagaaaacaaaggccctagagtggccattcttacctgaggagacggtgaccgtggtccctttgccccagacgtccatgtagtagtagtagtagtcgacttcggaacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttttcggaacaactgccactgagcgggctggcaaggc

SEQ ID NO: 2502 - DNA, 495 bp, Artificial Sequence
  source: /note="Description of Artificial Sequence: Synthetic polynucleotide"
gcctccctcgcgccatcagttcggaacttggactgggcagtagcagaaaacaaaggccctagagtggccattcttacctgaggagacggtgaccgtggtccctttgccccagacgtccatgtagtagtagtagtagtcgacttcggaacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggttcggaacttggactgctgagcgggctggcaaggc

SEQ ID NO: 2503 - DNA, 495 bp, Artificial Sequence
  source: /note="Description of Artificial Sequence: Synthetic polynucleotide"
gcctccctcgcgccatcagttcggaactcggtactggcagtagcagaaaacaaaggccctagagtggccattcttacctgaggagacggtgaccgtggtccctttgccccagacgtccatgtagtagtagtagtagtcgacttcggaactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgttcggaactcggtactctgagcgggctggcaaggc

SEQ ID NO: 2504 - DNA, 495 bp, Artificial Sequence
  source: /note="Description of Artificial Sequence: Synthetic polynucleotide"
gcctccctcgcgccatcagttcggaacccatggatggcagtagcagaaaacaaaggccctagagtggccattcttacctgaggagacggtgaccgtggtccctttgccccagacgtccatgtagtagtagtagtagtcgacttcggaacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacttcggaacccatggatctgagcgggctggcaaggc

SEQ ID NO: 2505 - DNA, 495 bp, Artificial Sequence
  source: /note="Description of Artificial Sequence: Synthetic polynucleotide"
gcctccctcgcgccatcagttcggaacacgaagatggcagtagcagaaaacaaaggccctagagtggccattcttacctgaggagacggtgaccgtggtccctttgccccagacgtccatgtagtagtagtagtagtcgacttcggaacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaattcggaacacgaagatctgagcgggctggcaaggc

SEQ ID NO: 2506 - DNA, 495 bp, Artificial Sequence
  source: /note="Description of Artificial Sequence: Synthetic polynucleotide"
gcctccctcgcgccatcagttcggaacactgtggaggcagtagcagaaaacaaaggccctagagtggccattcttacctgaggagacggtgaccgtggtccctttgccccagacgtccatgtagtagtagtagtagtcgacttcggaacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttttcggaacactgtggactgagcgggctggcaaggc

SEQ ID NO: 2507 - DNA, 495 bp, Artificial Sequence
  source: /note="Description of Artificial Sequence: Synthetic polynucleotide"
gcctccctcgcgccatcagttcggaacggtgtcatggcagtagcagaaaacaaaggccctagagtggccattcttacctgaggagacggtgaccgtggtccctttgccccagacgtccatgtagtagtagtagtagtcgacttcggaacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctttcggaacggtgtcatctgagcgggctggcaaggc

SEQ ID NO: 2508 - DNA, 495 bp, Artificial Sequence
  source: /note="Description of Artificial Sequence: Synthetic polynucleotide"
gcctccctcgcgccatcagttcggaactcgtgaagggcagtagcagaaaacaaaggccctagagtggccattcttacctgaggagacggtgaccgtggtccctttgccccagacgtccatgtagtagtagtagtagtcgacttcggaactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggttcggaactcgtgaagctgagcgggctggcaaggc

SEQ ID NO: 2509 - DNA, 495 bp, Artificial Sequence
  source: /note="Description of Artificial Sequence: Synthetic polynucleotide"
gcctccctcgcgccatcagttcggaaccactagctggcagtagcagaaaacaaaggccctagagtggccattcttacctgaggagacggtgaccgtggtccctttgccccagacgtccatgtagtagtagtagtagtcgacttcggaaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaattcggaaccactagctctgagcgggctggcaaggc

SEQ ID NO: 2510 - DNA, 495 bp, Artificial Sequence
  source: /note="Description of Artificial Sequence: Synthetic polynucleotide"
gcctccctcgcgccatcagttcggaacggtcaactggcagtagcagaaaacaaaggccctagagtggccattcttacctgaggagacggtgaccgtggtccctttgccccagacgtccatgtagtagtagtagtagtcgacttcggaacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggattcggaacggtcaactctgagcgggctggcaaggc

SEQ ID NO: 2511 - DNA, 495 bp, Artificial Sequence
  source: /note="Description of Artificial Sequence: Synthetic polynucleotide"
gcctccctcgcgccatcagttcggaactacgtacgggcagtagcagaaaacaaaggccctagagtggccattcttacctgaggagacggtgaccgtggtccctttgccccagacgtccatgtagtagtagtagtagtcgacttcggaactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcttcggaactacgtacgctgagcgggctggcaaggc

SEQ ID NO: 2512 - DNA, 495 bp, Artificial Sequence
  source: /note="Description of Artificial Sequence: Synthetic polynucleotide"
gcctccctcgcgccatcagttcggaacatgacaccggcagtagcagaaaacaaaggccctagagtggccattcttacctgaggagacggtgaccgtggtccctttgccccagacgtccatgtagtagtagtagtagtcgacttcggaacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggttcggaacatgacaccctgagcgggctggcaaggc

SEQ ID NO: 2513 - DNA, 495 bp, Artificial Sequence
  source: /note="Description of Artificial Sequence: Synthetic polynucleotide"
gcctccctcgcgccatcagttcggaaccttcacgaggcagtagcagaaaacaaaggccctagagtggccattcttacctgaggagacggtgaccgtggtccctttgccccagacgtccatgtagtagtagtagtagtcgacttcggaaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacttcggaaccttcacgactgagcgggctggcaaggc

SEQ ID NO: 2514 - DNA, 495 bp, Artificial Sequence
  source: /note="Description of Artificial Sequence: Synthetic polynucleotide"
gcctccctcgcgccatcagttcggaacagaatcagggcagtagcagaaaacaaaggccctagagtggccattcttacctgaggagacggtgaccgtggtccctttgccccagacgtccatgtagtagtagtagtagtcgacttcggaacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccttcggaacagaatcagctgagcgggctggcaaggc

SEQ ID NO: 2515 - DNA, 495 bp, Artificial Sequence
  source: /note="Description of Artificial Sequence: Synthetic polynucleotide"
gcctccctcgcgccatcagttcggaacagttatgcggcagtagcagaaaacaaaggccctagagtggccattcttacctgaggagacggtgaccgtggtccctttgccccagacgtccatgtagtagtagtagtagtcgacttcggaacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataattcggaacagttatgcctgagcgggctggcaaggc

SEQ ID NO: 2516 - DNA, 495 bp, Artificial Sequence
  source: /note="Description of Artificial Sequence: Synthetic polynucleotide"
gcctccctcgcgccatcagttcggaacaggtctcaggcagtagcagaaaacaaaggccctagagtggccattcttacctgaggagacggtgaccgtggtccctttgccccagacgtccatgtagtagtagtagtagtcgacttcggaacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccttcggaacaggtctcactgagcgggctggcaaggc

SEQ ID NO: 2517 - DNA, 495 bp, Artificial Sequence
  source: /note="Description of Artificial Sequence: Synthetic polynucleotide"
gcctccctcgcgccatcagttcggaacgtcatagtggcagtagcagaaaacaaaggccctagagtggccattcttacctgaggagacggtgaccgtggtccctttgccccagacgtccatgtagtagtagtagtagtcgacttcggaacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtttcggaacgtcatagtctgagcgggctggcaaggc

SEQ ID NO: 2518 - DNA, 495 bp, Artificial Sequence
  source: /note="Description of Artificial Sequence: Synthetic polynucleotide"
gcctccctcgcgccatcagttcggaacgtgacttgggcagtagcagaaaacaaaggccctagagtggccattcttacctgaggagacggtgaccgtggtccctttgccccagacgtccatgtagtagtagtagtagtcgacttcggaacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgttcggaacgtgacttgctgagcgggctggcaaggc

SEQ ID NO: 2519 - DNA, 495 bp, Artificial Sequence
  source: /note="Description of Artificial Sequence: Synthetic polynucleotide"
gcctccctcgcgccatcagttcggaacgattgcagggcagtagcagaaaacaaaggccctagagtggccattcttacctgaggagacggtgaccgtggtccctttgccccagacgtccatgtagtagtagtagtagtcgacttcggaacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccttcggaacgattgcagctgagcgggctggcaaggc

SEQ ID NO: 2520 - DNA, 495 bp, Artificial Sequence
  source: /note="Description of Artificial Sequence: Synthetic polynucleotide"
gcctccctcgcgccatcagttcggaacactatgacggcagtagcagaaaacaaaggccctagagtggccattcttacctgaggagacggtgaccgtggtccctttgccccagacgtccatgtagtagtagtagtagtcgacttcggaacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacttcggaacactatgacctgagcgggctggcaaggc

SEQ ID NO: 2521 - DNA, 495 bp, Artificial Sequence
  source: /note="Description of Artificial Sequence: Synthetic polynucleotide"
gcctccctcgcgccatcagttcggaacatggtcaaggcagtagcagaaaacaaaggccctagagtggccattcttacctgaggagacggtgaccgtggtccctttgccccagacgtccatgtagtagtagtagtagtcgacttcggaacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacttcggaacatggtcaactgagcgggctggcaaggc

SEQ ID NO: 2522 - DNA, 495 bp, Artificial Sequence
  source: /note="Description of Artificial Sequence: Synthetic polynucleotide"
gcctccctcgcgccatcagttcggaacgatggcttggcagtagcagaaaacaaaggccctagagtggccattcttacctgaggagacggtgaccgtggtccctttgccccagacgtccatgtagtagtagtagtagtcgacttcggaacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacttcggaacgatggcttctgagcgggctggcaaggc

SEQ ID NO: 2523 - DNA, 495 bp, Artificial Sequence
  source: /note="Description of Artificial Sequence: Synthetic polynucleotide"
gcctccctcgcgccatcagttcggaacagcatatgggcagtagcagaaaacaaaggccctagagtggccattcttacctgaggagacggtgaccgtggtccctttgccccagacgtccatgtagtagtagtagtagtcgacttcggaacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacttcggaacagcatatgctgagcgggctggcaaggc

SEQ ID NO: 2524 - DNA, 495 bp, Artificial Sequence
  source: /note="Description of Artificial Sequence: Synthetic polynucleotide"
gcctccctcgcgccatcagttcggaaccatatgctggcagtagcagaaaacaaaggccctagagtggccattcttacctgaggagacggtgaccgtggtccctttgccccagacgtccatgtagtagtagtagtagtcgacttcggaaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgttcggaaccatatgctctgagcgggctggcaaggc

SEQ ID NO: 2525 - DNA, 495 bp, Artificial Sequence
  source: /note="Description of Artificial Sequence: Synthetic polynucleotide"
gcctccctcgcgccatcagttcggaactcgtcgatggcagtagcagaaaacaaaggccctagagtggccattcttacctgaggagacggtgaccgtggtccctttgccccagacgtccatgtagtagtagtagtagtcgacttcggaactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccttcggaactcgtcgatctgagcgggctggcaaggc

SEQ ID NO: 2526 - DNA, 495 bp, Artificial Sequence
  source: /note="Description of Artificial Sequence: Synthetic polynucleotide"
gcctccctcgcgccatcagttcggaaccagtctgtggcagtagcagaaaacaaaggccctagagtggccattcttacctgaggagacggtgaccgtggtccctttgccccagacgtccatgtagtagtagtagtagtcgacttcggaaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcttcggaaccagtctgtctgagcgggctggcaaggc

SEQ ID NO: 2527 - DNA, 495 bp, Artificial Sequence
  source: /note="Description of Artificial Sequence: Synthetic polynucleotide"
gcctccctcgcgccatcagttcggaacaacgcgtaggcagtagcagaaaacaaaggccctagagtggccattcttacctgaggagacggtgaccgtggtccctttgccccagacgtccatgtagtagtagtagtagtcgacttcggaacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgttcggaacaacgcgtactgagcgggctggcaaggc

SEQ ID NO: 2528 - DNA, 495 bp, Artificial Sequence
  source: /note="Description of Artificial Sequence: Synthetic polynucleotide"
gcctccctcgcgccatcagttcggaacgtagttcgggcagtagcagaaaacaaaggccctagagtggccattcttacctgaggagacggtgaccgtggtccctttgccccagacgtccatgtagtagtagtagtagtcgacttcggaacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcttcggaacgtagttcgctgagcgggctggcaaggc

SEQ ID NO: 2529 - DNA, 495 bp, Artificial Sequence
  source: /note="Description of Artificial Sequence: Synthetic polynucleotide"
gcctccctcgcgccatcagttcggaaccgaactacggcagtagcagaaaacaaaggccctagagtggccattcttacctgaggagacggtgaccgtggtccctttgccccagacgtccatgtagtagtagtagtagtcgacttcggaaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacttcggaaccgaactacctgagcgggctggcaaggc

SEQ ID NO: 2530 - DNA, 495 bp, Artificial Sequence
  source: /note="Description of Artificial Sequence: Synthetic polynucleotide"
gcctccctcgcgccatcagttcggaacttaacgtcggcagtagcagaaaacaaaggccctagagtggccattcttacctgaggagacggtgaccgtggtccctttgccccagacgtccatgtagtagtagtagtagtcgacttcggaacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccttcggaacttaacgtcctgagcgggctggcaaggc

SEQ ID NO: 2531 - DNA, 495 bp, Artificial Sequence
  source: /note="Description of Artificial Sequence: Synthetic polynucleotide"
gcctccctcgcgccatcagttcggaacagcaacctggcagtagcagaaaacaaaggccctagagtggccattcttacctgaggagacggtgaccgtggtccctttgccccagacgtccatgtagtagtagtagtagtcgacttcggaacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacttcggaacagcaacctctgagcgggctggcaaggc

SEQ ID NO: 2532 - DNA, 495 bp, Artificial Sequence
  source: /note="Description of Artificial Sequence: Synthetic polynucleotide"
gcctccctcgcgccatcagttcggaacttctcgagggcagtagcagaaaacaaaggccctagagtggccattcttacctgaggagacggtgaccgtggtccctttgccccagacgtccatgtagtagtagtagtagtcgacttcggaacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttttcggaacttctcgagctgagcgggctggcaaggc

SEQ ID NO: 2533 - DNA, 495 bp, Artificial Sequence
  source: /note="Description of Artificial Sequence: Synthetic polynucleotide"
gcctccctcgcgccatcagttcggaacactctacgggcagtagcagaaaacaaaggccctagagtggccattcttacctgaggagacggtgaccgtggtccctttgccccagacgtccatgtagtagtagtagtagtcgacttcggaacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacttcggaacactctacgctgagcgggctggcaaggc

SEQ ID NO: 2534 - DNA, 495 bp, Artificial Sequence
  source: /note="Description of Artificial Sequence: Synthetic polynucleotide"
gcctccctcgcgccatcagttcggaactaccggaaggcagtagcagaaaacaaaggccctagagtggccattcttacctgaggagacggtgaccgtggtccctttgccccagacgtccatgtagtagtagtagtagtcgacttcggaactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccttcggaactaccggaactgagcgggctggcaaggc

SEQ ID NO: 2535 - DNA, 495 bp, Artificial Sequence
  source: /note="Description of Artificial Sequence: Synthetic polynucleotide"
gcctccctcgcgccatcagttcggaaccgaattgcggcagtagcagaaaacaaaggccctagagtggccattcttacctgaggagacggtgaccgtggtccctttgccccagacgtccatgtagtagtagtagtagtcgacttcggaaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacttcggaaccgaattgcctgagcgggctggcaaggc

SEQ ID NO: 2536 - DNA, 495 bp, Artificial Sequence
  source: /note="Description of Artificial Sequence: Synthetic polynucleotide"
gcctccctcgcgccatcagttcggaacttcgctcaggcagtagcagaaaacaaaggccctagagtggccattcttacctgaggagacggtgaccgtggtccctttgccccagacgtccatgtagtagtagtagtagtcgacttcggaacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacattcggaacttcgctcactgagcgggctggcaaggc

SEQ ID NO: 2537 - DNA, 495 bp, Artificial Sequence
  source: /note="Description of Artificial Sequence: Synthetic polynucleotide"
gcctccctcgcgccatcagttcggaacgacgttaaggcagtagcagaaaacaaaggccctagagtggccattcttacctgaggagacggtgaccgtggtccctttgccccagacgtccatgtagtagtagtagtagtcgacttcggaacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgttcggaacgacgttaactgagcgggctggcaaggc

SEQ ID NO: 2538 - DNA, 495 bp, Artificial Sequence
  source: /note="Description of Artificial Sequence: Synthetic polynucleotide"
gcctccctcgcgccatcagttcggaaccgtagagtggcagtagcagaaaacaaaggccctagagtggccattcttacctgaggagacggtgaccgtggtccctttgccccagacgtccatgtagtagtagtagtagtcgacttcggaaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcttcggaaccgtagagtctgagcgggctggcaaggc

SEQ ID NO: 2539 - DNA, 495 bp, Artificial Sequence
  source: /note="Description of Artificial Sequence: Synthetic polynucleotide"
gcctccctcgcgccatcagttcggaacttccggtaggcagtagcagaaaacaaaggccctagagtggccattcttacctgaggagacggtgaccgtggtccctttgccccagacgtccatgtagtagtagtagtagtcgacttcggaacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcttcggaacttccggtactgagcgggctggcaaggc

SEQ ID NO: 2540 - DNA, 495 bp, Artificial Sequence
  source: /note="Description of Artificial Sequence: Synthetic polynucleotide"
gcctccctcgcgccatcagttcggaacgcaattcgggcagtagcagaaaacaaaggccctagagtggccattcttacctgaggagacggtgaccgtggtccctttgccccagacgtccatgtagtagtagtagtagtcgacttcggaacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacttcggaacgcaattcgctgagcgggctggcaaggc

SEQ ID NO: 2541 - DNA, 495 bp, Artificial Sequence
  source: /note="Description of Artificial Sequence: Synthetic polynucleotide"
gcctccctcgcgccatcagttcggaactgagcgaaggcagtagcagaaaacaaaggccctagagtggccattcttacctgaggagacggtgaccgtggtccctttgccccagacgtccatgtagtagtagtagtagtcgacttcggaactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcttcggaactgagcgaactgagcgggctggcaaggc

SEQ ID NO: 2542 - DNA, 495 bp, Artificial Sequence
  source: /note="Description of Artificial Sequence: Synthetic polynucleotide"
gcctccctcgcgccatcagttcggaactactaagcggcagtagcagaaaacaaaggccctagagtggccattcttacctgaggagacggtgaccgtggtccctttgccccagacgtccatgtagtagtagtagtagtcgacttcggaactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccttcggaactactaagcctgagcgggctggcaaggc

SEQ ID NO: 2543 - DNA, 495 bp, Artificial Sequence
  source: /note="Description of Artificial Sequence: Synthetic polynucleotide"
gcctccctcgcgccatcagttcggaactggcgtatggcagtagcagaaaacaaaggccctagagtggccattcttacctgaggagacggtgaccgtggtccctttgccccagacgtccatgtagtagtagtagtagtcgacttcggaactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtttcggaactggcgtatctgagcgggctggcaaggc

SEQ ID NO: 2544 - DNA, 495 bp, Artificial Sequence
  source: /note="Description of Artificial Sequence: Synthetic polynucleotide"
gcctccctcgcgccatcagttcggaacgataaccaggcagtagcagaaaacaaaggccctagagtggccattcttacctgaggagacggtgaccgtggtccctttgccccagacgtccatgtagtagtagtagtagtcgacttcggaacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgttcggaacgataaccactgagcgggctggcaaggc

SEQ ID NO: 2545 - DNA, 495 bp, Artificial Sequence
  source: /note="Description of Artificial Sequence: Synthetic polynucleotide"
gcctccctcgcgccatcagttcggaacctagtgaaggcagtagcagaaaacaaaggccctagagtggccattcttacctgaggagacggtgaccgtggtccctttgccccagacgtccatgtagtagtagtagtagtcgacttcggaacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagttcggaacctagtgaactgagcgggctggcaaggc

SEQ ID NO: 2546 - DNA, 495 bp, Artificial Sequence
  source: /note="Description of Artificial Sequence: Synthetic polynucleotide"
gcctccctcgcgccatcagttcggaacacgttcacggcagtagcagaaaacaaaggccctagagtggccattcttacctgaggagacggtgaccgtggtccctttgccccagacgtccatgtagtagtagtagtagtcgacttcggaacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtttcggaacacgttcacctgagcgggctggcaaggc

SEQ ID NO: 2547 - DNA, 448 bp, Artificial Sequence
  source: /note="Description of Artificial Sequence: Synthetic polynucleotide"
gcctccctcgcgccatcagttcggaacattacgctggcagtagcagaaaacaaaggccctagagtggccattcttacctgaggagacggtgaccgtggtccctttgccccagacgtccatgtagtagtagtagtagtcgacttcggaacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcattcggaacattacgctctgagcgggctggcaaggc

SEQ ID NO: 2548 - DNA, 495 bp, Artificial Sequence
  source: /note="Description of Artificial Sequence: Synthetic polynucleotide"
gcctccctcgcgccatcagttcggaaccattgagtggcagtagcagaaaacaaaggccctagagtggccattcttacctgaggagacggtgaccgtggtccctttgccccagacgtccatgtagtagtagtagtagtcgacttcggaaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccttcggaaccattgagtctgagcgggctggcaaggc

SEQ ID NO: 2549 - DNA, 495 bp, Artificial Sequence
  source: /note="Description of Artificial Sequence: Synthetic polynucleotide"
gcctccctcgcgccatcagaagtaacgcttggttatcagctcagccaaaaccctgcggctggtagggggcctgtggggctgggggctgatgtggctgcggtctccagggcgggtcgggtccaggggcccccagcagtcgacaagtaacgcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccaagtaacgcttggttactgagcgggctggcaaggc

SEQ ID NO: 2550 - DNA, 495 bp, Artificial Sequence
  source: /note="Description of Artificial Sequence: Synthetic polynucleotide"
gcctccctcgcgccatcagaagtaacgacctcttgtcagctcagccaaaaccctgcggctggtagggggcctgtggggctgggggctgatgtggctgcggtctccagggcgggtcgggtccaggggcccccagcagtcgacaagtaacgacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccaagtaacgacctcttgctgagcgggctggcaaggc

SEQ ID NO: 2551 - DNA, 495 bp, Artificial Sequence
  source: /note="Description of Artificial Sequence: Synthetic polynucleotide"
gcctccctcgcgccatcagaagtaacgctgattcttcagctcagccaaaaccctgcggctggtagggggcctgtggggctgggggctgatgtggctgcggtctccagggcgggtcgggtccaggggcccccagcagtcgacaagtaacgctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccaagtaacgctgattctctgagcgggctggcaaggc

SEQ ID NO: 2552 - DNA, 495 bp, Artificial Sequence
  source: /note="Description of Artificial Sequence: Synthetic polynucleotide"
gcctccctcgcgccatcagaagtaacgagtaccgatcagctcagccaaaaccctgcggctggtagggggcctgtggggctgggggctgatgtggctgcggtctccagggcgggtcgggtccaggggcccccagcagtcgacaagtaacgagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccaagtaacgagtaccgactgagcgggctggcaaggc

SEQ ID NO: 2553 - DNA, 495 bp, Artificial Sequence
  source: /note="Description of Artificial Sequence: Synthetic polynucleotide"
gcctccctcgcgccatcagaagtaacgatccatggtcagctcagccaaaaccctgcggctggtagggggcctgtggggctgggggctgatgtggctgcggtctccagggcgggtcgggtccaggggcccccagcagtcgacaagtaacgatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccaagtaacgatccatggctgagcgggctggcaaggc

SEQ ID NO: 2554 - DNA, 495 bp, Artificial Sequence
  source: /note="Description of Artificial Sequence: Synthetic polynucleotide"
gcctccctcgcgccatcagaagtaacggtagcagttcagctcagccaaaaccctgcggctggtagggggcctgtggggctgggggctgatgtggctgcggtctccagggcgggtcgggtccaggggcccccagcagtcgacaagtaacggtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcaagtaacggtagcagtctgagcgggctggcaaggc

SEQ ID NO: 2555 - DNA, 495 bp, Artificial Sequence
  source: /note="Description of Artificial Sequence: Synthetic polynucleotide"
gcctccctcgcgccatcagaagtaacgatcttcgttcagctcagccaaaaccctgcggctggtagggggcctgtggggctgggggctgatgtggctgcggtctccagggcgggtcgggtccaggggcccccagcagtcgacaagtaacgatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccaagtaacgatcttcgtctgagcgggctggcaaggc

SEQ ID NO: 2556 - DNA, 495 bp, Artificial Sequence
  source: /note="Description of Artificial Sequence: Synthetic polynucleotide"
gcctccctcgcgccatcagaagtaacgtccacagttcagctcagccaaaaccctgcggctggtagggggcctgtggggctgggggctgatgtggctgcggtctccagggcgggtcgggtccaggggcccccagcagtcgacaagtaacgtccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccaagtaacgtccacagtctgagcgggctggcaaggc

SEQ ID NO: 2557 - DNA, 495 bp, Artificial Sequence
  source: /note="Description of Artificial Sequence: Synthetic polynucleotide"
gcctccctcgcgccatcagaagtaacgagctagtgtcagctcagccaaaaccctgcggctggtagggggcctgtggggctgggggctgatgtggctgcggtctccagggcgggtcgggtccaggggcccccagcagtcgacaagtaacgagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccaagtaacgagctagtgctgagcgggctggcaaggc

SEQ ID NO: 2558 - DNA, 495 bp, Artificial Sequence
  source: /note="Description of Artificial Sequence: Synthetic polynucleotide"
gcctccctcgcgccatcagaagtaacgtaaccaagtcagctcagccaaaaccctgcggctggtagggggcctgtggggctgggggctgatgtggctgcggtctccagggcgggtcgggtccaggggcccccagcagtcgacaagtaacgtaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccaagtaacgtaaccaagctgagcgggctggcaaggc

SEQ ID NO: 2559 - DNA, 495 bp, Artificial Sequence
  source: /note="Description of Artificial Sequence: Synthetic polynucleotide"
gcctccctcgcgccatcagaagtaacgcaagaggttcagctcagccaaaaccctgcggctggtagggggcctgtggggctgggggctgatgtggctgcggtctccagggcgggtcgggtccaggggcccccagcagtcgacaagtaacgcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccaagtaacgcaagaggtctgagcgggctggcaaggc

SEQ ID NO: 2560 - DNA, 495 bp, Artificial Sequence
  source: /note="Description of Artificial Sequence: Synthetic polynucleotide"
gcctccctcgcgccatcagaagtaacgagttgacctcagctcagccaaaaccctgcggctggtagggggcctgtggggctgggggctgatgtggctgcggtctccagggcgggtcgggtccaggggcccccagcagtcgacaagtaacgagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaaagtaacgagttgaccctgagcgggctggcaaggc

SEQ ID NO: 2561 - DNA, 495 bp, Artificial Sequence
  source: /note="Description of Artificial Sequence: Synthetic polynucleotide"
gcctccctcgcgccatcagaagtaacgcagcatattcagctcagccaaaaccctgcggctggtagggggcctgtggggctgggggctgatgtggctgcggtctccagggcgggtcgggtccaggggcccccagcagtcgacaagtaacgcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaaagtaacgcagcatatctgagcgggctggcaaggc

SEQ ID NO: 2562 - DNA, 495 bp, Artificial Sequence
  source: /note="Description of Artificial Sequence: Synthetic polynucleotide"
gcctccctcgcgccatcagaagtaacggcaggatttcagctcagccaaaaccctgcggctggtagggggcctgtggggctgggggctgatgtggctgcggtctccagggcgggtcgggtccaggggcccccagcagtcgacaagtaacggcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaaagtaacggcaggattctgagcgggctggcaaggc

SEQ ID NO: 2563 - DNA, 495 bp, Artificial Sequence
  source: /note="Description of Artificial Sequence: Synthetic polynucleotide"
gcctccctcgcgccatcagaagtaacggtccattctcagctcagccaaaaccctgcggctggtagggggcctgtggggctgggggctgatgtggctgcggtctccagggcgggtcgggtccaggggcccccagcagtcgacaagtaacggtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccaagtaacggtccattcctgagcgggctggcaaggc

SEQ ID NO: 2564 - DNA, 495 bp, Artificial Sequence
  source: /note="Description of Artificial Sequence: Synthetic polynucleotide"
gcctccctcgcgccatcagaagtaacggcataacttcagctcagccaaaaccctgcggctggtagggggcctgtggggctgggggctgatgtggctgcggtctccagggcgggtcgggtccaggggcccccagcagtcgacaagtaacggcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacaagtaacggcataactctgagcgggctggcaaggc

SEQ ID NO: 2565 - DNA, 495 bp, Artificial Sequence
  source: /note="Description of Artificial Sequence: Synthetic polynucleotide"
gcctccctcgcgccatcagaagtaacgatatgctgtcagctcagccaaaaccctgcggctggtagggggcctgtggggctgggggctgatgtggctgcggtctccagggcgggtcgggtccaggggcccccagcagtcgacaagtaacgatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccaagtaacgatatgctgctgagcgggctggcaaggc

SEQ ID NO: 2566 - DNA, 495 bp, Artificial Sequence
  source: /note="Description of Artificial Sequence: Synthetic polynucleotide"
gcctccctcgcgccatcagaagtaacgaatcctgctcagctcagccaaaaccctgcggctggtagggggcctgtggggctgggggctgatgtggctgcggtctccagggcgggtcgggtccaggggcccccagcagtcgacaagtaacgaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcaagtaacgaatcctgcctgagcgggctggcaaggc

SEQ ID NO: 2567 - DNA, 495 bp, Artificial Sequence
  source: /note="Description of Artificial Sequence: Synthetic polynucleotide"
gcctccctcgcgccatcagaagtaacgtgagaccttcagctcagccaaaaccctgcggctggtagggggcctgtggggctgggggctgatgtggctgcggtctccagggcgggtcgggtccaggggcccccagcagtcgacaagtaacgtgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgaagtaacgtgagacctctgagcgggctggcaaggc

SEQ ID NO: 2568 - DNA, 495 bp, Artificial Sequence
  source: /note="Description of Artificial Sequence: Synthetic polynucleotide"
gcctccctcgcgccatcagaagtaacggaatggactcagctcagccaaaaccctgcggctggtagggggcctgtggggctgggggctgatgtggctgcggtctccagggcgggtcgggtccaggggcccccagcagtcgacaagtaacggaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccaagtaacggaatggacctgagcgggctggcaaggc

SEQ ID NO: 2569 - DNA, 495 bp, Artificial Sequence
  source: /note="Description of Artificial Sequence: Synthetic polynucleotide"
gcctccctcgcgccatcagaagtaacgcacatggatcagctcagccaaaaccctgcggctggtagggggcctgtggggctgggggctgatgtggctgcggtctccagggcgggtcgggtccaggggcccccagcagtcgacaagtaacgcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccaagtaacgcacatggactgagcgggctggcaaggc

SEQ ID NO: 2570 - DNA, 495 bp, Artificial Sequence
  source: /note="Description of Artificial Sequence: Synthetic polynucleotide"
gcctccctcgcgccatcagaagtaacgttgaccattcagctcagccaaaaccctgcggctggtagggggcctgtggggctgggggctgatgtggctgcggtctccagggcgggtcgggtccaggggcccccagcagtcgacaagtaacgttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccaagtaacgttgaccatctgagcgggctggcaaggc

SEQ ID NO: 2571 - DNA, 495 bp, Artificial Sequence
  source: /note="Description of Artificial Sequence: Synthetic polynucleotide"
gcctccctcgcgccatcagaagtaacgaagccatctcagctcagccaaaaccctgcggctggtagggggcctgtggggctgggggctgatgtggctgcggtctccagggcgggtcgggtccaggggcccccagcagtcgacaagtaacgaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccaagtaacgaagccatcctgagcgggctggcaaggc

SEQ ID NO: 2572 - DNA, 495 bp, Artificial Sequence
  source: /note="Description of Artificial Sequence: Synthetic polynucleotide"
gcctccctcgcgccatcagaagtaacgtccatgtgtcagctcagccaaaaccctgcggctggtagggggcctgtggggctgggggctgatgtggctgcggtctccagggcgggtcgggtccaggggcccccagcagtcgacaagtaacgtccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgtccatgtgctgagcgggctggcaaggc

SEQ ID NO: 2573 - DNA, 495 bp, Artificial Sequence
  source: /note="Description of Artificial Sequence: Synthetic polynucleotide"
gcctccctcgcgccatcagaagtaacgcaagtcactcagctcagccaaaaccctgcggctggtagggggcctgtggggctgggggctgatgtggctgcggtctccagggcgggtcgggtccaggggcccccagcagtcgacaagtaacgcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgcaagtcacctgagcgggctggcaaggc

SEQ ID NO: 2574 - DNA, 495 bp, Artificial Sequence
  source: /note="Description of Artificial Sequence: Synthetic polynucleotide"
gcctccctcgcgccatcagaagtaacgctgcaatctcagctcagccaaaaccctgcggctggtagggggcctgtggggctgggggctgatgtggctgcggtctccagggcgggtcgggtccaggggcccccagcagtcgacaagtaacgctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccaagtaacgctgcaatcctgagcgggctggcaaggc

SEQ ID NO: 2575 - DNA, 495 bp, Artificial Sequence
  source: /note="Description of Artificial Sequence: Synthetic polynucleotide"
gcctccctcgcgccatcagaagtaacgatcgacgatcagctcagccaaaaccctgcggctggtagggggcctgtggggctgggggctgatgtggctgcggtctccagggcgggtcgggtccaggggcccccagcagtcgacaagtaacgatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccaagtaacgatcgacgactgagcgggctggcaaggc

SEQ ID NO: 2576 - DNA, 495 bp, Artificial Sequence
  source: /note="Description of Artificial Sequence: Synthetic polynucleotide"
gcctccctcgcgccatcagaagtaacgacagactgtcagctcagccaaaaccctgcggctggtagggggcctgtggggctgggggctgatgtggctgcggtctccagggcgggtcgggtccaggggcccccagcagtcgacaagtaacgacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaaagtaacgacagactgctgagcgggctggcaaggc

SEQ ID NO: 2577 - DNA, 495 bp, Artificial Sequence
  source: /note="Description of Artificial Sequence: Synthetic polynucleotide"
gcctccctcgcgccatcagaagtaacgccttatagtcagctcagccaaaaccctgcggctggtagggggcctgtggggctgggggctgatgtggctgcggtctccagggcgggtcgggtccaggggcccccagcagtcgacaagtaacgccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacaagtaacgccttatagctgagcgggctggcaaggc

SEQ ID NO: 2578 - DNA, 495 bp, Artificial Sequence
  source: /note="Description of Artificial Sequence: Synthetic polynucleotide"
gcctccctcgcgccatcagaagtaacgtacgcgtttcagctcagccaaaaccctgcggctggtagggggcctgtggggctgggggctgatgtggctgcggtctccagggcgggtcgggtccaggggcccccagcagtcgacaagtaacgtacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccaagtaacgtacgcgttctgagcgggctggcaaggc

SEQ ID NO: 2579 - DNA, 495 bp, Artificial Sequence
  source: /note="Description of Artificial Sequence: Synthetic polynucleotide"
gcctccctcgcgccatcagaagtaacgctataaggtcagctcagccaaaaccctgcggctggtagggggcctgtggggctgggggctgatgtggctgcggtctccagggcgggtcgggtccaggggcccccagcagtcgacaagtaacgctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgaagtaacgctataaggctgagcgggctggcaaggc

SEQ ID NO: 2580 - DNA, 495 bp, Artificial Sequence
  source: /note="Description of Artificial Sequence: Synthetic polynucleotide"
gcctccctcgcgccatcagaagtaacgtcttagtctcagctcagccaaaaccctgcggctggtagggggcctgtggggctgggggctgatgtggctgcggtctccagggcgggtcgggtccaggggcccccagcagtcgacaagtaacgtcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacgtcttagtcctgagcgggctggcaaggc

SEQ ID NO: 2581 - DNA, 495 bp, Artificial Sequence
  source: /note="Description of Artificial Sequence: Synthetic polynucleotide"
gcctccctcgcgccatcagaagtaacgtgtctgcatcagctcagccaaaaccctgcggctggtagggggcctgtggggctgggggctgatgtggctgcggtctccagggcgggtcgggtccaggggcccccagcagtcgacaagtaacgtgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccaagtaacgtgtctgcactgagcgggctggcaaggc

SEQ ID NO: 2582 - DNA, 495 bp, Artificial Sequence
  source: /note="Description of Artificial Sequence: Synthetic polynucleotide"
gcctccctcgcgccatcagaagtaacggccattaatcagctcagccaaaaccctgcggctggtagggggcctgtggggctgggggctgatgtggctgcggtctccagggcgggtcgggtccaggggcccccagcagtcgacaagtaacggccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacggccattaactgagcgggctggcaaggc

SEQ ID NO: 2583 - DNA, 495 bp, Artificial Sequence
  source: /note="Description of Artificial Sequence: Synthetic polynucleotide"
gcctccctcgcgccatcagaagtaacggactaagatcagctcagccaaaaccctgcggctggtagggggcctgtggggctgggggctgatgtggctgcggtctccagggcgggtcgggtccaggggcccccagcagtcgacaagtaacggactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgaagtaacggactaagactgagcgggctggcaaggc

SEQ ID NO: 2584 - DNA, 495 bp, Artificial Sequence
  source: /note="Description of Artificial Sequence: Synthetic polynucleotide"
gcctccctcgcgccatcagaagtaacgaggttgcttcagctcagccaaaaccctgcggctggtagggggcctgtggggctgggggctgatgtggctgcggtctccagggcgggtcgggtccaggggcccccagcagtcgacaagtaacgaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgaagtaacgaggttgctctgagcgggctggcaaggc

SEQ ID NO: 2585 - DNA, 495 bp, Artificial Sequence
  source: /note="Description of Artificial Sequence: Synthetic polynucleotide"
gcctccctcgcgccatcagaagtaacgctcgagaatcagctcagccaaaaccctgcggctggtagggggcctgtggggctgggggctgatgtggctgcggtctccagggcgggtcgggtccaggggcccccagcagtcgacaagtaacgctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccaagtaacgctcgagaactgagcgggctggcaaggc

SEQ ID NO: 2586 - DNA, 495 bp, Artificial Sequence
  source: /note="Description of Artificial Sequence: Synthetic polynucleotide"
gcctccctcgcgccatcagaagtaacgttaatggctcagctcagccaaaaccctgcggctggtagggggcctgtggggctgggggctgatgtggctgcggtctccagggcgggtcgggtccaggggcccccagcagtcgacaagtaacgttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccaagtaacgttaatggcctgagcgggctggcaaggc

SEQ ID NO: 2587 - DNA, 495 bp, Artificial Sequence
  source: /note="Description of Artificial Sequence: Synthetic polynucleotide"
gcctccctcgcgccatcagaagtaacgtgcagacatcagctcagccaaaaccctgcggctggtagggggcctgtggggctgggggctgatgtggctgcggtctccagggcgggtcgggtccaggggcccccagcagtcgacaagtaacgtgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaaagtaacgtgcagacactgagcgggctggcaaggc

SEQ ID NO: 2588 - DNA, 495 bp, Artificial Sequence
  source: /note="Description of Artificial Sequence: Synthetic polynucleotide"
gcctccctcgcgccatcagaagtaacgtcactgagtcagctcagccaaaaccctgcggctggtagggggcctgtggggctgggggctgatgtggctgcggtctccagggcgggtcgggtccaggggcccccagcagtcgacaagtaacgtcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtaagtaacgtcactgagctgagcgggctggcaaggc

SEQ ID NO: 2589 - DNA, 495 bp, Artificial Sequence
  source: /note="Description of Artificial Sequence: Synthetic polynucleotide"
gcctccctcgcgccatcagaagtaacggagtacgttcagctcagccaaaaccctgcggctggtagggggcctgtggggctgggggctgatgtggctgcggtctccagggcgggtcgggtccaggggcccccagcagtcgacaagtaacggagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacaagtaacggagtacgtctgagcgggctggcaaggc

SEQ ID NO: 2590 - DNA, 495 bp, Artificial Sequence
  source: /note="Description of Artificial Sequence: Synthetic polynucleotide"
gcctccctcgcgccatcagaagtaacgatacgccatcagctcagccaaaaccctgcggctggtagggggcctgtggggctgggggctgatgtggctgcggtctccagggcgggtcgggtccaggggcccccagcagtcgacaagtaacgatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacaagtaacgatacgccactgagcgggctggcaaggc

SEQ ID NO: 2591 - DNA, 495 bp, Artificial Sequence
  source: /note="Description of Artificial Sequence: Synthetic polynucleotide"
gcctccctcgcgccatcagaagtaacgtcgcatcatcagctcagccaaaaccctgcggctggtagggggcctgtggggctgggggctgatgtggctgcggtctccagggcgggtcgggtccaggggcccccagcagtcgacaagtaacgtcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacaagtaacgtcgcatcactgagcgggctggcaaggc

SEQ ID NO: 2592 - DNA, 495 bp, Artificial Sequence
  source: /note="Description of Artificial Sequence: Synthetic polynucleotide"
gcctccctcgcgccatcagaagtaacgcgcttaattcagctcagccaaaaccctgcggctggtagggggcctgtggggctgggggctgatgtggctgcggtctccagggcgggtcgggtccaggggcccccagcagtcgacaagtaacgcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacaagtaacgcgcttaatctgagcgggctggcaaggc

SEQ ID NO: 2593 - DNA, 495 bp, Artificial Sequence
  source: /note="Description of Artificial Sequence: Synthetic polynucleotide"
gcctccctcgcgccatcagaagtaacgtggttatctcagctcagccaaaaccctgcggctggtagggggcctgtggggctgggggctgatgtggctgcggtctccagggcgggtcgggtccaggggcccccagcagtcgacaagtaacgtggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtaagtaacgtggttatcctgagcgggctggcaaggc

SEQ ID NO: 2594 - DNA, 495 bp, Artificial Sequence
  source: /note="Description of Artificial Sequence: Synthetic polynucleotide"
gcctccctcgcgccatcagaagtaacgggattgcttcagctcagccaaaaccctgcggctggtagggggcctgtggggctgggggctgatgtggctgcggtctccagggcgggtcgggtccaggggcccccagcagtcgacaagtaacgggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacaagtaacgggattgctctgagcgggctggcaaggc

SEQ ID NO: 2595 - DNA, 495 bp, Artificial Sequence
  source: /note="Description of Artificial Sequence: Synthetic polynucleotide"
gcctccctcgcgccatcagaagtaacgctcagtgatcagctcagccaaaaccctgcggctggtagggggcctgtggggctgggggctgatgtggctgcggtctccagggcgggtcgggtccaggggcccccagcagtcgacaagtaacgctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtaagtaacgctcagtgactgagcgggctggcaaggc

SEQ ID NO: 2596 - DNA, 495 bp, Artificial Sequence
  source: /note="Description of Artificial Sequence: Synthetic polynucleotide"
gcctccctcgcgccatcagaagtaacgacgtactctcagctcagccaaaaccctgcggctggtagggggcctgtggggctgggggctgatgtggctgcggtctccagggcgggtcgggtccaggggcccccagcagtcgacaagtaacgacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacaagtaacgacgtactcctgagcgggctggcaaggc

SEQ ID NO: 2597 - DNA, 495 bp, Artificial Sequence
  source: /note="Description of Artificial Sequence: Synthetic polynucleotide"
gcctccctcgcgccatcagaagtaacgtgatgcgatcagctcagccaaaaccctgcggctggtagggggcctgtggggctgggggctgatgtggctgcggtctccagggcgggtcgggtccaggggcccccagcagtcgacaagtaacgtgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccaagtaacgtgatgcgactgagcgggctggcaaggc

SEQ ID NO: 2598 - DNA, 495 bp, Artificial Sequence
  source: /note="Description of Artificial Sequence: Synthetic polynucleotide"
gcctccctcgcgccatcagaagtaacgattaagcgtcagctcagccaaaaccctgcggctggtagggggcctgtggggctgggggctgatgtggctgcggtctccagggcgggtcgggtccaggggcccccagcagtcgacaagtaacgattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccaagtaacgattaagcgctgagcgggctggcaaggc

SEQ ID NO: 2599 - DNA, 495 bp, Artificial Sequence
  source: /note="Description of Artificial Sequence: Synthetic polynucleotide"
gcctccctcgcgccatcagaagtaacgagcaatcctcagctcagccaaaaccctgcggctggtagggggcctgtggggctgggggctgatgtggctgcggtctccagggcgggtcgggtccaggggcccccagcagtcgacaagtaacgagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccaagtaacgagcaatccctgagcgggctggcaaggc

SEQ ID NO: 2600 - DNA, 495 bp, Artificial Sequence
  source: /note="Description of Artificial Sequence: Synthetic polynucleotide"
gcctccctcgcgccatcagaagtaacggcttagtatcagctcagccaaaaccctgcggctggtagggggcctgtggggctgggggctgatgtggctgcggtctccagggcgggtcgggtccaggggcccccagcagtcgacaagtaacggcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaaagtaacggcttagtactgagcgggctggcaaggc

SEQ ID NO: 2601 - DNA, 495 bp, Artificial Sequence
  source: /note="Description of Artificial Sequence: Synthetic polynucleotide"
gcctccctcgcgccatcagaagtaacgtgaccttgtcagctcagccaaaaccctgcggctggtagggggcctgtggggctgggggctgatgtggctgcggtctccagggcgggtcgggtccaggggcccccagcagtcgacaagtaacgtgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccaagtaacgtgaccttgctgagcgggctggcaaggc

SEQ ID NO: 2602 - DNA, 495 bp, Artificial Sequence
  source: /note="Description of Artificial Sequence: Synthetic polynucleotide"
gcctccctcgcgccatcagaagtaacgcaaggtcatcagctcagccaaaaccctgcggctggtagggggcctgtggggctgggggctgatgtggctgcggtctccagggcgggtcgggtccaggggcccccagcagtcgacaagtaacgcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccaagtaacgcaaggtcactgagcgggctggcaaggc

SEQ ID NO: 2603 - DNA, 495 bp, Artificial Sequence
  source: /note="Description of Artificial Sequence: Synthetic polynucleotide"
gcctccctcgcgccatcagaagtaacgcactgtactcagctcagccaaaaccctgcggctggtagggggcctgtggggctgggggctgatgtggctgcggtctccagggcgggtcgggtccaggggcccccagcagtcgacaagtaacgcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcaagtaacgcactgtacctgagcgggctggcaaggc

SEQ ID NO: 2604 - DNA, 495 bp, Artificial Sequence
  source: /note="Description of Artificial Sequence: Synthetic polynucleotide"
gcctccctcgcgccatcagaagtaacggatgatcctcagctcagccaaaaccctgcggctggtagggggcctgtggggctgggggctgatgtggctgcggtctccagggcgggtcgggtccaggggcccccagcagtcgacaagtaacggatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggaagtaacggatgatccctgagcgggctggcaaggc

SEQ ID NO: 2605 - DNA, 495 bp, Artificial Sequence
  source: /note="Description of Artificial Sequence: Synthetic polynucleotide"
gcctccctcgcgccatcagaagtaacgcgccaatatcagctcagccaaaaccctgcggctggtagggggcctgtggggctgggggctgatgtggctgcggtctccagggcgggtcgggtccaggggcccccagcagtcgacaagtaacgcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggaagtaacgcgccaatactgagcgggctggcaaggc

SEQ ID NO: 2606 - DNA, 495 bp, Artificial Sequence
  source: /note="Description of Artificial Sequence: Synthetic polynucleotide"
gcctccctcgcgccatcagaagtaacgtcaagccttcagctcagccaaaaccctgcggctggtagggggcctgtggggctgggggctgatgtggctgcggtctccagggcgggtcgggtccaggggcccccagcagtcgacaagtaacgtcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaaagtaacgtcaagcctctgagcgggctggcaaggc

SEQ ID NO: 2607 - DNA, 495 bp, Artificial Sequence
  source: /note="Description of Artificial Sequence: Synthetic polynucleotide"
gcctccctcgcgccatcagaagtaacgacgtgtgttcagctcagccaaaaccctgcggctggtagggggcctgtggggctgggggctgatgtggctgcggtctccagggcgggtcgggtccaggggcccccagcagtcgacaagtaacgacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagaagtaacgacgtgtgtctgagcgggctggcaaggc

SEQ ID NO: 2608 - DNA, 495 bp, Artificial Sequence
  source: /note="Description of Artificial Sequence: Synthetic polynucleotide"
gcctccctcgcgccatcagaagtaacgtccgtctatcagctcagccaaaaccctgcggctggtagggggcctgtggggctgggggctgatgtggctgcggtctccagggcgggtcgggtccaggggcccccagcagtcgacaagtaacgtccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagaagtaacgtccgtctactgagcgggctggcaaggc

SEQ ID NO: 2609 - DNA, 495 bp, Artificial Sequence
  source: /note="Description of Artificial Sequence: Synthetic polynucleotide"
gcctccctcgcgccatcagaagtaacgaagagctgtcagctcagccaaaaccctgcggctggtagggggcctgtggggctgggggctgatgtggctgcggtctccagggcgggtcgggtccaggggcccccagcagtcgacaagtaacgaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgaagtaacgaagagctgctgagcgggctggcaaggc

SEQ ID NO: 2610 - DNA, 495 bp, Artificial Sequence
  source: /note="Description of Artificial Sequence: Synthetic polynucleotide"
gcctccctcgcgccatcagaagtaacgtatcgctctcagctcagccaaaaccctgcggctggtagggggcctgtggggctgggggctgatgtggctgcggtctccagggcgggtcgggtccaggggcccccagcagtcgacaagtaacgtatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagaagtaacgtatcgctcctgagcgggctggcaaggc

SEQ ID NO: 2611 - DNA, 495 bp, Artificial Sequence
  source: /note="Description of Artificial Sequence: Synthetic polynucleotide"
gcctccctcgcgccatcagaagtaacgtcagatgctcagctcagccaaaaccctgcggctggtagggggcctgtggggctgggggctgatgtggctgcggtctccagggcgggtcgggtccaggggcccccagcagtcgacaagtaacgtcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccaagtaacgtcagatgcctgagcgggctggcaaggc

SEQ ID NO: 2612 - DNA, 495 bp, Artificial Sequence
  source: /note="Description of Artificial Sequence: Synthetic polynucleotide"
gcctccctcgcgccatcagaagtaacggtgtagcatcagctcagccaaaaccctgcggctggtagggggcctgtggggctgggggctgatgtggctgcggtctccagggcgggtcgggtccaggggcccccagcagtcgacaagtaacggtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgaagtaacggtgtagcactgagcgggctggcaaggc

SEQ ID NO: 2613 - DNA, 495 bp, Artificial Sequence
  source: /note="Description of Artificial Sequence: Synthetic polynucleotide"
gcctccctcgcgccatcagaagtaacgtggcagtttcagctcagccaaaaccctgcggctggtagggggcctgtggggctgggggctgatgtggctgcggtctccagggcgggtcgggtccaggggcccccagcagtcgacaagtaacgtggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgaagtaacgtggcagttctgagcgggctggcaaggc

SEQ ID NO: 2614 - DNA, 495 bp, Artificial Sequence
  source: /note="Description of Artificial Sequence: Synthetic polynucleotide"
gcctccctcgcgccatcagaagtaacgcagtccaatcagctcagccaaaaccctgcggctggtagggggcctgtggggctgggggctgatgtggctgcggtctccagggcgggtcgggtccaggggcccccagcagtcgacaagtaacgcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacaagtaacgcagtccaactgagcgggctggcaaggc

SEQ ID NO: 2615 - DNA, 495 bp, Artificial Sequence
  source: /note="Description of Artificial Sequence: Synthetic polynucleotide"
gcctccctcgcgccatcagaagtaacggtgtctactcagctcagccaaaaccctgcggctggtagggggcctgtggggctgggggctgatgtggctgcggtctccagggcgggtcgggtccaggggcccccagcagtcgacaagtaacggtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggaagtaacggtgtctacctgagcgggctggcaaggc

SEQ ID NO: 2616 - DNA, 495 bp, Artificial Sequence
  source: /note="Description of Artificial Sequence: Synthetic polynucleotide"
gcctccctcgcgccatcagaagtaacggtacagtgtcagctcagccaaaaccctgcggctggtagggggcctgtggggctgggggctgatgtggctgcggtctccagggcgggtcgggtccaggggcccccagcagtcgacaagtaacggtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagaagtaacggtacagtgctgagcgggctggcaaggc

SEQ ID NO: 2617 - DNA, 495 bp, Artificial Sequence
  source: /note="Description of Artificial Sequence: Synthetic polynucleotide"
gcctccctcgcgccatcagaagtaacgggatcatctcagctcagccaaaaccctgcggctggtagggggcctgtggggctgggggctgatgtggctgcggtctccagggcgggtcgggtccaggggcccccagcagtcgacaagtaacgggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagaagtaacgggatcatcctgagcgggctggcaaggc

SEQ ID NO: 2618 - DNA, 495 bp, Artificial Sequence
  source: /note="Description of Artificial Sequence: Synthetic polynucleotide"
gcctccctcgcgccatcagaagtaacgtattggcgtcagctcagccaaaaccctgcggctggtagggggcctgtggggctgggggctgatgtggctgcggtctccagggcgggtcgggtccaggggcccccagcagtcgacaagtaacgtattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaaagtaacgtattggcgctgagcgggctggcaaggc

SEQ ID NO: 2619 - DNA, 495 bp, Artificial Sequence
  source: /note="Description of Artificial Sequence: Synthetic polynucleotide"
gcctccctcgcgccatcagaagtaacgaggcttgatcagctcagccaaaaccctgcggctggtagggggcctgtggggctgggggctgatgtggctgcggtctccagggcgggtcgggtccaggggcccccagcagtcgacaagtaacgaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacaagtaacgaggcttgactgagcgggctggcaaggc

SEQ ID NO: 2620 - DNA, 495 bp, Artificial Sequence
  source: /note="Description of Artificial Sequence: Synthetic polynucleotide"
gcctccctcgcgccatcagaagtaacgacacacgttcagctcagccaaaaccctgcggctggtagggggcctgtggggctgggggctgatgtggctgcggtctccagggcgggtcgggtccaggggcccccagcagtcgacaagtaacgacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcataagtaacgacacacgtctgagcgggctggcaaggc

SEQ ID NO: 2621 - DNA, 495 bp, Artificial Sequence
  source: /note="Description of Artificial Sequence: Synthetic polynucleotide"
gcctccctcgcgccatcagaagtaacgtagacggatcagctcagccaaaaccctgcggctggtagggggcctgtggggctgggggctgatgtggctgcggtctccagggcgggtcgggtccaggggcccccagcagtcgacaagtaacgtagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaaagtaacgtagacggactgagcgggctggcaaggc

SEQ ID NO: 2622 - DNA, 495 bp, Artificial Sequence
  source: /note="Description of Artificial Sequence: Synthetic polynucleotide"
gcctccctcgcgccatcagaagtaacggagcgatatcagctcagccaaaaccctgcggctggtagggggcctgtggggctgggggctgatgtggctgcggtctccagggcgggtcgggtccaggggcccccagcagtcgacaagtaacggagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttaagtaacggagcgatactgagcgggctggcaaggc

SEQ ID NO: 2623 - DNA, 495 bp, Artificial Sequence
  source: /note="Description of Artificial Sequence: Synthetic polynucleotide"
gcctccctcgcgccatcagaagtaacggcatctgatcagctcagccaaaaccctgcggctggtagggggcctgtggggctgggggctgatgtggctgcggtctccagggcgggtcgggtccaggggcccccagcagtcgacaagtaacggcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaaagtaacggcatctgactgagcgggctggcaaggc

SEQ ID NO: 2624 - DNA, 495 bp, Artificial Sequence
  source: /note="Description of Artificial Sequence: Synthetic polynucleotide"
gcctccctcgcgccatcagaagtaacgtgctacactcagctcagccaaaaccctgcggctggtagggggcctgtggggctgggggctgatgtggctgcggtctccagggcgggtcgggtccaggggcccccagcagtcgacaagtaacgtgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgaagtaacgtgctacacctgagcgggctggcaaggc

SEQ ID NO: 2625 - DNA, 495 bp, Artificial Sequence
  source: /note="Description of Artificial Sequence: Synthetic polynucleotide"
gcctccctcgcgccatcagaagtaacgaactgccatcagctcagccaaaaccctgcggctggtagggggcctgtggggctgggggctgatgtggctgcggtctccagggcgggtcgggtccaggggcccccagcagtcgacaagtaacgaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttaagtaacgaactgccactgagcgggctggcaaggc

SEQ ID NO: 2626 - DNA, 495 bp, Artificial Sequence
  source: /note="Description of Artificial Sequence: Synthetic polynucleotide"
gcctccctcgcgccatcagaagtaacgttggactgtcagctcagccaaaaccctgcggctggtagggggcctgtggggctgggggctgatgtggctgcggtctccagggcgggtcgggtccaggggcccccagcagtcgacaagtaacgttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggaagtaacgttggactgctgagcgggctggcaaggc

SEQ ID NO: 2627 - DNA, 495 bp, Artificial Sequence
  source: /note="Description of Artificial Sequence: Synthetic polynucleotide"
gcctccctcgcgccatcagaagtaacgtcggtacttcagctcagccaaaaccctgcggctggtagggggcctgtggggctgggggctgatgtggctgcggtctccagggcgggtcgggtccaggggcccccagcagtcgacaagtaacgtcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgaagtaacgtcggtactctgagcgggctggcaaggc

SEQ ID NO: 2628 - DNA, 495 bp, Artificial Sequence
  source: /note="Description of Artificial Sequence: Synthetic polynucleotide"
gcctccctcgcgccatcagaagtaacgccatggattcagctcagccaaaaccctgcggctggtagggggcctgtggggctgggggctgatgtggctgcggtctccagggcgggtcgggtccaggggcccccagcagtcgacaagtaacgccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacaagtaacgccatggatctgagcgggctggcaaggc

SEQ ID NO: 2629 - DNA, 495 bp, Artificial Sequence
  source: /note="Description of Artificial Sequence: Synthetic polynucleotide"
gcctccctcgcgccatcagaagtaacgacgaagattcagctcagccaaaaccctgcggctggtagggggcctgtggggctgggggctgatgtggctgcggtctccagggcgggtcgggtccaggggcccccagcagtcgacaagtaacgacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaaagtaacgacgaagatctgagcgggctggcaaggc

SEQ ID NO: 2630 - DNA, 495 bp, Artificial Sequence
  source: /note="Description of Artificial Sequence: Synthetic polynucleotide"
gcctccctcgcgccatcagaagtaacgactgtggatcagctcagccaaaaccctgcggctggtagggggcctgtggggctgggggctgatgtggctgcggtctccagggcgggtcgggtccaggggcccccagcagtcgacaagtaacgactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttaagtaacgactgtggactgagcgggctggcaaggc

SEQ ID NO: 2631 - DNA, 495 bp, Artificial Sequence
  source: /note="Description of Artificial Sequence: Synthetic polynucleotide"
gcctccctcgcgccatcagaagtaacgggtgtcattcagctcagccaaaaccctgcggctggtagggggcctgtggggctgggggctgatgtggctgcggtctccagggcgggtcgggtccaggggcccccagcagtcgacaagtaacgggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctaagtaacgggtgtcatctgagcgggctggcaaggc

SEQ ID NO: 2632 - DNA, 495 bp, Artificial Sequence
  source: /note="Description of Artificial Sequence: Synthetic polynucleotide"
gcctccctcgcgccatcagaagtaacgtcgtgaagtcagctcagccaaaaccctgcggctggtagggggcctgtggggctgggggctgatgtggctgcggtctccagggcgggtcgggtccaggggcccccagcagtcgacaagtaacgtcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggaagtaacgtcgtgaagctgagcgggctggcaaggc

SEQ ID NO: 2633 - DNA, 495 bp, Artificial Sequence
  source: /note="Description of Artificial Sequence: Synthetic polynucleotide"
gcctccctcgcgccatcagaagtaacgcactagcttcagctcagccaaaaccctgcggctggtagggggcctgtggggctgggggctgatgtggctgcggtctccagggcgggtcgggtccaggggcccccagcagtcgacaagtaacgcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaaagtaacgcactagctctgagcgggctggcaaggc

SEQ ID NO: 2634 - DNA, 495 bp, Artificial Sequence
  source: /note="Description of Artificial Sequence: Synthetic polynucleotide"
gcctccctcgcgccatcagaagtaacgggtcaacttcagctcagccaaaaccctgcggctggtagggggcctgtggggctgggggctgatgtggctgcggtctccagggcgggtcgggtccaggggcccccagcagtcgacaagtaacgggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaaagtaacgggtcaactctgagcgggctggcaaggc

SEQ ID NO: 2635 - DNA, 495 bp, Artificial Sequence
  source: /note="Description of Artificial Sequence: Synthetic polynucleotide"
gcctccctcgcgccatcagaagtaacgtacgtacgtcagctcagccaaaaccctgcggctggtagggggcctgtggggctgggggctgatgtggctgcggtctccagggcgggtcgggtccaggggcccccagcagtcgacaagtaacgtacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcaagtaacgtacgtacgctgagcgggctggcaaggc

SEQ ID NO: 2636 - DNA, 495 bp, Artificial Sequence
  source: /note="Description of Artificial Sequence: Synthetic polynucleotide"
gcctccctcgcgccatcagaagtaacgatgacacctcagctcagccaaaaccctgcggctggtagggggcctgtggggctgggggctgatgtggctgcggtctccagggcgggtcgggtccaggggcccccagcagtcgacaagtaacgatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggaagtaacgatgacaccctgagcgggctggcaaggc

SEQ ID NO: 2637 - DNA, 495 bp, Artificial Sequence
  source: /note="Description of Artificial Sequence: Synthetic polynucleotide"
gcctccctcgcgccatcagaagtaacgcttcacgatcagctcagccaaaaccctgcggctggtagggggcctgtggggctgggggctgatgtggctgcggtctccagggcgggtcgggtccaggggcccccagcagtcgacaagtaacgcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacaagtaacgcttcacgactgagcgggctggcaaggc

SEQ ID NO: 2638 - DNA, 495 bp, Artificial Sequence
  source: /note="Description of Artificial Sequence: Synthetic polynucleotide"
gcctccctcgcgccatcagaagtaacgagaatcagtcagctcagccaaaaccctgcggctggtagggggcctgtggggctgggggctgatgtggctgcggtctccagggcgggtcgggtccaggggcccccagcagtcgacaagtaacgagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccaagtaacgagaatcagctgagcgggctggcaaggc

SEQ ID NO: 2639 - DNA, 495 bp, Artificial Sequence
  source: /note="Description of Artificial Sequence: Synthetic polynucleotide"
gcctccctcgcgccatcagaagtaacgagttatgctcagctcagccaaaaccctgcggctggtagggggcctgtggggctgggggctgatgtggctgcggtctccagggcgggtcgggtccaggggcccccagcagtcgacaagtaacgagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaaagtaacgagttatgcctgagcgggctggcaaggc

SEQ ID NO: 2640 - DNA, 495 bp, Artificial Sequence
  source: /note="Description of Artificial Sequence: Synthetic polynucleotide"
gcctccctcgcgccatcagaagtaacgaggtctcatcagctcagccaaaaccctgcggctggtagggggcctgtggggctgggggctgatgtggctgcggtctccagggcgggtcgggtccaggggcccccagcagtcgacaagtaacgaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccaagtaacgaggtctcactgagcgggctggcaaggc

SEQ ID NO: 2641 - DNA, 495 bp, Artificial Sequence
  source: /note="Description of Artificial Sequence: Synthetic polynucleotide"
gcctccctcgcgccatcagaagtaacggtcatagttcagctcagccaaaaccctgcggctggtagggggcctgtggggctgggggctgatgtggctgcggtctccagggcgggtcgggtccaggggcccccagcagtcgacaagtaacggtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtaagtaacggtcatagtctgagcgggctggcaaggc

SEQ ID NO: 2642 - DNA, 495 bp, Artificial Sequence
  source: /note="Description of Artificial Sequence: Synthetic polynucleotide"
gcctccctcgcgccatcagaagtaacggtgacttgtcagctcagccaaaaccctgcggctggtagggggcctgtggggctgggggctgatgtggctgcggtctccagggcgggtcgggtccaggggcccccagcagtcgacaagtaacggtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgaagtaacggtgacttgctgagcgggctggcaaggc

SEQ ID NO: 2643 - DNA, 495 bp, Artificial Sequence
  source: /note="Description of Artificial Sequence: Synthetic polynucleotide"
gcctccctcgcgccatcagaagtaacggattgcagtcagctcagccaaaaccctgcggctggtagggggcctgtggggctgggggctgatgtggctgcggtctccagggcgggtcgggtccaggggcccccagcagtcgacaagtaacggattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccaagtaacggattgcagctgagcgggctggcaaggc

SEQ ID NO: 2644 - DNA, 495 bp, Artificial Sequence
  source: /note="Description of Artificial Sequence: Synthetic polynucleotide"
gcctccctcgcgccatcagaagtaacgactatgactcagctcagccaaaaccctgcggctggtagggggcctgtggggctgggggctgatgtggctgcggtctccagggcgggtcgggtccaggggcccccagcagtcgacaagtaacgactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacaagtaacgactatgacctgagcgggctggcaaggc

SEQ ID NO: 2645 - DNA, 495 bp, Artificial Sequence
  source: /note="Description of Artificial Sequence: Synthetic polynucleotide"
gcctccctcgcgccatcagaagtaacgatggtcaatcagctcagccaaaaccctgcggctggtagggggcctgtggggctgggggctgatgtggctgcggtctccagggcgggtcgggtccaggggcccccagcagtcgacaagtaacgatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacaagtaacgatggtcaactgagcgggctggcaaggc

SEQ ID NO: 2646 - DNA, 495 bp, Artificial Sequence
  source: /note="Description of Artificial Sequence: Synthetic polynucleotide"
gcctccctcgcgccatcagaagtaacggatggctttcagctcagccaaaaccctgcggctggtagggggcctgtggggctgggggctgatgtggctgcggtctccagggcgggtcgggtccaggggcccccagcagtcgacaagtaacggatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacaagtaacggatggcttctgagcgggctggcaaggc

SEQ ID NO: 2647 - DNA, 495 bp, Artificial Sequence
  source: /note="Description of Artificial Sequence: Synthetic polynucleotide"
gcctccctcgcgccatcagaagtaacgagcatatgtcagctcagccaaaaccctgcggctggtagggggcctgtggggctgggggctgatgtggctgcggtctccagggcgggtcgggtccaggggcccccagcagtcgacaagtaacgagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacaagtaacgagcatatgctgagcgggctggcaaggc

SEQ ID NO: 2648 - DNA, 495 bp, Artificial Sequence
  source: /note="Description of Artificial Sequence: Synthetic polynucleotide"
gcctccctcgcgccatcagaagtaacgcatatgcttcagctcagccaaaaccctgcggctggtagggggcctgtggggctgggggctgatgtggctgcggtctccagggcgggtcgggtccaggggcccccagcagtcgacaagtaacgcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgaagtaacgcatatgctctgagcgggctggcaaggc

SEQ ID NO: 2649 - DNA, 495 bp, Artificial Sequence
  source: /note="Description of Artificial Sequence: Synthetic polynucleotide"
gcctccctcgcgccatcagaagtaacgtcgtcgattcagctcagccaaaaccctgcggctggtagggggcctgtggggctgggggctgatgtggctgcggtctccagggcgggtcgggtccaggggcccccagcagtcgacaagtaacgtcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccaagtaacgtcgtcgatctgagcgggctggcaaggc

SEQ ID NO: 2650 - DNA, 495 bp, Artificial Sequence
  source: /note="Description of Artificial Sequence: Synthetic polynucleotide"
gcctccctcgcgccatcagaagtaacgcagtctgttcagctcagccaaaaccctgcggctggtagggggcctgtggggctgggggctgatgtggctgcggtctccagggcgggtcgggtccaggggcccccagcagtcgacaagtaacgcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcaagtaacgcagtctgtctgagcgggctggcaaggc

SEQ ID NO: 2651 - DNA, 495 bp, Artificial Sequence
  source: /note="Description of Artificial Sequence: Synthetic polynucleotide"
gcctccctcgcgccatcagaagtaacgaacgcgtatcagctcagccaaaaccctgcggctggtagggggcctgtggggctgggggctgatgtggctgcggtctccagggcgggtcgggtccaggggcccccagcagtcgacaagtaacgaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgaagtaacgaacgcgtactgagcgggctggcaaggc

SEQ ID NO: 2652 - DNA, 495 bp, Artificial Sequence
  source: /note="Description of Artificial Sequence: Synthetic polynucleotide"
gcctccctcgcgccatcagaagtaacggtagttcgtcagctcagccaaaaccctgcggctggtagggggcctgtggggctgggggctgatgtggctgcggtctccagggcgggtcgggtccaggggcccccagcagtcgacaagtaacggtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcaagtaacggtagttcgctgagcgggctggcaaggc

SEQ ID NO: 2653 - DNA, 495 bp, Artificial Sequence
  source: /note="Description of Artificial Sequence: Synthetic polynucleotide"
gcctccctcgcgccatcagaagtaacgcgaactactcagctcagccaaaaccctgcggctggtagggggcctgtggggctgggggctgatgtggctgcggtctccagggcgggtcgggtccaggggcccccagcagtcgacaagtaacgcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacaagtaacgcgaactacctgagcgggctggcaaggc

SEQ ID NO: 2654 - DNA, 495 bp, Artificial Sequence
  source: /note="Description of Artificial Sequence: Synthetic polynucleotide"
gcctccctcgcgccatcagaagtaacgttaacgtctcagctcagccaaaaccctgcggctggtagggggcctgtggggctgggggctgatgtggctgcggtctccagggcgggtcgggtccaggggcccccagcagtcgacaagtaacgttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccaagtaacgttaacgtcctgagcgggctggcaaggc

SEQ ID NO: 2655 - DNA, 495 bp, Artificial Sequence
  source: /note="Description of Artificial Sequence: Synthetic polynucleotide"
gcctccctcgcgccatcagaagtaacgagcaaccttcagctcagccaaaaccctgcggctggtagggggcctgtggggctgggggctgatgtggctgcggtctccagggcgggtcgggtccaggggcccccagcagtcgacaagtaacgagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacaagtaacgagcaacctctgagcgggctggcaaggc

SEQ ID NO: 2656 - DNA, 495 bp, Artificial Sequence
  source: /note="Description of Artificial Sequence: Synthetic polynucleotide"
gcctccctcgcgccatcagaagtaacgttctcgagtcagctcagccaaaaccctgcggctggtagggggcctgtggggctgggggctgatgtggctgcggtctccagggcgggtcgggtccaggggcccccagcagtcgacaagtaacgttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttaagtaacgttctcgagctgagcgggctggcaaggc

SEQ ID NO: 2657 - DNA, 495 bp, Artificial Sequence
  source: /note="Description of Artificial Sequence: Synthetic polynucleotide"
gcctccctcgcgccatcagaagtaacgactctacgtcagctcagccaaaaccctgcggctggtagggggcctgtggggctgggggctgatgtggctgcggtctccagggcgggtcgggtccaggggcccccagcagtcgacaagtaacgactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacaagtaacgactctacgctgagcgggctggcaaggc

SEQ ID NO: 2658 - DNA, 495 bp, Artificial Sequence
  source: /note="Description of Artificial Sequence: Synthetic polynucleotide"
gcctccctcgcgccatcagaagtaacgtaccggaatcagctcagccaaaaccctgcggctggtagggggcctgtggggctgggggctgatgtggctgcggtctccagggcgggtcgggtccaggggcccccagcagtcgacaagtaacgtaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccaagtaacgtaccggaactgagcgggctggcaaggc

SEQ ID NO: 2659 - DNA, 495 bp, Artificial Sequence
  source: /note="Description of Artificial Sequence: Synthetic polynucleotide"
gcctccctcgcgccatcagaagtaacgcgaattgctcagctcagccaaaaccctgcggctggtagggggcctgtggggctgggggctgatgtggctgcggtctccagggcgggtcgggtccaggggcccccagcagtcgacaagtaacgcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacaagtaacgcgaattgcctgagcgggctggcaaggc

SEQ ID NO: 2660 - DNA, 495 bp, Artificial Sequence
  source: /note="Description of Artificial Sequence: Synthetic polynucleotide"
gcctccctcgcgccatcagaagtaacgttcgctcatcagctcagccaaaaccctgcggctggtagggggcctgtggggctgggggctgatgtggctgcggtctccagggcgggtcgggtccaggggcccccagcagtcgacaagtaacgttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaaagtaacgttcgctcactgagcgggctggcaaggc

SEQ ID NO: 2661 - DNA, 495 bp, Artificial Sequence
  source: /note="Description of Artificial Sequence: Synthetic polynucleotide"
gcctccctcgcgccatcagaagtaacggacgttaatcagctcagccaaaaccctgcggctggtagggggcctgtggggctgggggctgatgtggctgcggtctccagggcgggtcgggtccaggggcccccagcagtcgacaagtaacggacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgaagtaacggacgttaactgagcgggctggcaaggc

SEQ ID NO: 2662 - DNA, 495 bp, Artificial Sequence
  source: /note="Description of Artificial Sequence: Synthetic polynucleotide"
gcctccctcgcgccatcagaagtaacgcgtagagttcagctcagccaaaaccctgcggctggtagggggcctgtggggctgggggctgatgtggctgcggtctccagggcgggtcgggtccaggggcccccagcagtcgacaagtaacgcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcaagtaacgcgtagagtctgagcgggctggcaaggc

SEQ ID NO: 2663 - DNA, 495 bp, Artificial Sequence
  source: /note="Description of Artificial Sequence: Synthetic polynucleotide"
gcctccctcgcgccatcagaagtaacgttccggtatcagctcagccaaaaccctgcggctggtagggggcctgtggggctgggggctgatgtggctgcggtctccagggcgggtcgggtccaggggcccccagcagtcgacaagtaacgttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcaagtaacgttccggtactgagcgggctggcaaggc

SEQ ID NO: 2664 - DNA, 495 bp, Artificial Sequence
  source: /note="Description of Artificial Sequence: Synthetic polynucleotide"
gcctccctcgcgccatcagaagtaacggcaattcgtcagctcagccaaaaccctgcggctggtagggggcctgtggggctgggggctgatgtggctgcggtctccagggcgggtcgggtccaggggcccccagcagtcgacaagtaacggcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacaagtaacggcaattcgctgagcgggctggcaaggc

SEQ ID NO: 2665 - DNA, 495 bp, Artificial Sequence
  source: /note="Description of Artificial Sequence: Synthetic polynucleotide"
gcctccctcgcgccatcagaagtaacgtgagcgaatcagctcagccaaaaccctgcggctggtagggggcctgtggggctgggggctgatgtggctgcggtctccagggcgggtcgggtccaggggcccccagcagtcgacaagtaacgtgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcaagtaacgtgagcgaactgagcgggctggcaaggc

SEQ ID NO: 2666 - DNA, 495 bp, Artificial Sequence
  source: /note="Description of Artificial Sequence: Synthetic polynucleotide"
gcctccctcgcgccatcagaagtaacgtactaagctcagctcagccaaaaccctgcggctggtagggggcctgtggggctgggggctgatgtggctgcggtctccagggcgggtcgggtccaggggcccccagcagtcgacaagtaacgtactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccaagtaacgtactaagcctgagcgggctggcaaggc

SEQ ID NO: 2667 - DNA, 495 bp, Artificial Sequence
  source: /note="Description of Artificial Sequence: Synthetic polynucleotide"
gcctccctcgcgccatcagaagtaacgtggcgtattcagctcagccaaaaccctgcggctggtagggggcctgtggggctgggggctgatgtggctgcggtctccagggcgggtcgggtccaggggcccccagcagtcgacaagtaacgtggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtaagtaacgtggcgtatctgagcgggctggcaaggc

SEQ ID NO: 2668 - DNA, 495 bp, Artificial Sequence
  source: /note="Description of Artificial Sequence: Synthetic polynucleotide"
gcctccctcgcgccatcagaagtaacggataaccatcagctcagccaaaaccctgcggctggtagggggcctgtggggctgggggctgatgtggctgcggtctccagggcgggtcgggtccaggggcccccagcagtcgacaagtaacggataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgaagtaacggataaccactgagcgggctggcaaggc

SEQ ID NO: 2669 - DNA, 495 bp, Artificial Sequence
  source: /note="Description of Artificial Sequence: Synthetic polynucleotide"
gcctccctcgcgccatcagaagtaacgctagtgaatcagctcagccaaaaccctgcggctggtagggggcctgtggggctgggggctgatgtggctgcggtctccagggcgggtcgggtccaggggcccccagcagtcgacaagtaacgctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagaagtaacgctagtgaactgagcgggctggcaaggc

SEQ ID NO: 2670 - DNA, 495 bp, Artificial Sequence
  source: /note="Description of Artificial Sequence: Synthetic polynucleotide"
gcctccctcgcgccatcagaagtaacgacgttcactcagctcagccaaaaccctgcggctggtagggggcctgtggggctgggggctgatgtggctgcggtctccagggcgggtcgggtccaggggcccccagcagtcgacaagtaacgacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtaagtaacgacgttcacctgagcgggctggcaaggc

SEQ ID NO: 2671 - DNA, 448 bp, Artificial Sequence
  source: /note="Description of Artificial Sequence: Synthetic polynucleotide"
gcctccctcgcgccatcagaagtaacgattacgcttcagctcagccaaaaccctgcggctggtagggggcctgtggggctgggggctgatgtggctgcggtctccagggcgggtcgggtccaggggcccccagcagtcgacaagtaacgattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaaagtaacgattacgctctgagcgggctggcaaggc

SEQ ID NO: 2672 - DNA, 495 bp, Artificial Sequence
  source: /note="Description of Artificial Sequence: Synthetic polynucleotide"
gcctccctcgcgccatcagaagtaacgcattgagttcagctcagccaaaaccctgcggctggtagggggcctgtggggctgggggctgatgtggctgcggtctccagggcgggtcgggtccaggggcccccagcagtcgacaagtaacgcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccaagtaacgcattgagtctgagcgggctggcaaggc

SEQ ID NO: 2673 - DNA, 495 bp, Artificial Sequence
  source: /note="Description of Artificial Sequence: Synthetic polynucleotide"
gcctccctcgcgccatcaggtctcctacttggttaccagccacacagacccccgggctgagacccaggcagggaggggtgacgttcccagggagacggtggccgggctgccctggccccagtgctccaagcacttgtcgacgtctcctacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtctcctacttggttactgagcgggctggcaaggc

SEQ ID NO: 2674 - DNA, 495 bp, Artificial Sequence
  source: /note="Description of Artificial Sequence: Synthetic polynucleotide"
gcctccctcgcgccatcaggtctcctaacctcttgccagccacacagacccccgggctgagacccaggcagggaggggtgacgttcccagggagacggtggccgggctgccctggccccagtgctccaagcacttgtcgacgtctcctaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtctcctaacctcttgctgagcgggctggcaaggc

SEQ ID NO: 2675 - DNA, 495 bp, Artificial Sequence
  source: /note="Description of Artificial Sequence: Synthetic polynucleotide"
gcctccctcgcgccatcaggtctcctactgattctccagccacacagacccccgggctgagacccaggcagggaggggtgacgttcccagggagacggtggccgggctgccctggccccagtgctccaagcacttgtcgacgtctcctactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtctcctactgattctctgagcgggctggcaaggc

SEQ ID NO: 2676 - DNA, 495 bp, Artificial Sequence
  source: /note="Description of Artificial Sequence: Synthetic polynucleotide"
gcctccctcgcgccatcaggtctcctaagtaccgaccagccacacagacccccgggctgagacccaggcagggaggggtgacgttcccagggagacggtggccgggctgccctggccccagtgctccaagcacttgtcgacgtctcctaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtctcctaagtaccgactgagcgggctggcaaggc

SEQ ID NO: 2677 - DNA, 495 bp, Artificial Sequence
  source: /note="Description of Artificial Sequence: Synthetic polynucleotide"
gcctccctcgcgccatcaggtctcctaatccatggccagccacacagacccccgggctgagacccaggcagggaggggtgacgttcccagggagacggtggccgggctgccctggccccagtgctccaagcacttgtcgacgtctcctaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtctcctaatccatggctgagcgggctggcaaggc

SEQ ID NO: 2678 - DNA, 495 bp, Artificial Sequence
  source: /note="Description of Artificial Sequence: Synthetic polynucleotide"
gcctccctcgcgccatcaggtctcctagtagcagtccagccacacagacccccgggctgagacccaggcagggaggggtgacgttcccagggagacggtggccgggctgccctggccccagtgctccaagcacttgtcgacgtctcctagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtctcctagtagcagtctgagcgggctggcaaggc

SEQ ID NO: 2679 - DNA, 495 bp, Artificial Sequence
  source: /note="Description of Artificial Sequence: Synthetic polynucleotide"
gcctccctcgcgccatcaggtctcctaatcttcgtccagccacacagacccccgggctgagacccaggcagggaggggtgacgttcccagggagacggtggccgggctgccctggccccagtgctccaagcacttgtcgacgtctcctaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtctcctaatcttcgtctgagcgggctggcaaggc

SEQ ID NO: 2680 - DNA, 495 bp, Artificial Sequence
  source: /note="Description of Artificial Sequence: Synthetic polynucleotide"
gcctccctcgcgccatcaggtctcctatccacagtccagccacacagacccccgggctgagacccaggcagggaggggtgacgttcccagggagacggtggccgggctgccctggccccagtgctccaagcacttgtcgacgtctcctatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtctcctatccacagtctgagcgggctggcaaggc

SEQ ID NO: 2681 - DNA, 495 bp, Artificial Sequence
  source: /note="Description of Artificial Sequence: Synthetic polynucleotide"
gcctccctcgcgccatcaggtctcctaagctagtgccagccacacagacccccgggctgagacccaggcagggaggggtgacgttcccagggagacggtggccgggctgccctggccccagtgctccaagcacttgtcgacgtctcctaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtctcctaagctagtgctgagcgggctggcaaggc

SEQ ID NO: 2682 - DNA, 495 bp, Artificial Sequence
  source: /note="Description of Artificial Sequence: Synthetic polynucleotide"
gcctccctcgcgccatcaggtctcctataaccaagccagccacacagacccccgggctgagacccaggcagggaggggtgacgttcccagggagacggtggccgggctgccctggccccagtgctccaagcacttgtcgacgtctcctataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtctcctataaccaagctgagcgggctggcaaggc

SEQ ID NO: 2683 - DNA, 495 bp, Artificial Sequence
  source: /note="Description of Artificial Sequence: Synthetic polynucleotide"
gcctccctcgcgccatcaggtctcctacaagaggtccagccacacagacccccgggctgagacccaggcagggaggggtgacgttcccagggagacggtggccgggctgccctggccccagtgctccaagcacttgtcgacgtctcctacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtctcctacaagaggtctgagcgggctggcaaggc

SEQ ID NO: 2684 - DNA, 495 bp, Artificial Sequence
  source: /note="Description of Artificial Sequence: Synthetic polynucleotide"
gcctccctcgcgccatcaggtctcctaagttgaccccagccacacagacccccgggctgagacccaggcagggaggggtgacgttcccagggagacggtggccgggctgccctggccccagtgctccaagcacttgtcgacgtctcctaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtctcctaagttgaccctgagcgggctggcaaggc

SEQ ID NO: 2685 - DNA, 495 bp, Artificial Sequence
  source: /note="Description of Artificial Sequence: Synthetic polynucleotide"
gcctccctcgcgccatcaggtctcctacagcatatccagccacacagacccccgggctgagacccaggcagggaggggtgacgttcccagggagacggtggccgggctgccctggccccagtgctccaagcacttgtcgacgtctcctacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtctcctacagcatatctgagcgggctggcaaggc

SEQ ID NO: 2686 - DNA, 495 bp, Artificial Sequence
  source: /note="Description of Artificial Sequence: Synthetic polynucleotide"
gcctccctcgcgccatcaggtctcctagcaggattccagccacacagacccccgggctgagacccaggcagggaggggtgacgttcccagggagacggtggccgggctgccctggccccagtgctccaagcacttgtcgacgtctcctagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtctcctagcaggattctgagcgggctggcaaggc

SEQ ID NO: 2687 - DNA, 495 bp, Artificial Sequence
  source: /note="Description of Artificial Sequence: Synthetic polynucleotide"
gcctccctcgcgccatcaggtctcctagtccattcccagccacacagacccccgggctgagacccaggcagggaggggtgacgttcccagggagacggtggccgggctgccctggccccagtgctccaagcacttgtcgacgtctcctagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtctcctagtccattcctgagcgggctggcaaggc

SEQ ID NO: 2688 - DNA, 495 bp, Artificial Sequence
  source: /note="Description of Artificial Sequence: Synthetic polynucleotide"
gcctccctcgcgccatcaggtctcctagcataactccagccacacagacccccgggctgagacccaggcagggaggggtgacgttcccagggagacggtggccgggctgccctggccccagtgctccaagcacttgtcgacgtctcctagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtctcctagcataactctgagcgggctggcaaggc

SEQ ID NO: 2689 - DNA, 495 bp, Artificial Sequence
  source: /note="Description of Artificial Sequence: Synthetic polynucleotide"
gcctccctcgcgccatcaggtctcctaatatgctgccagccacacagacccccgggctgagacccaggcagggaggggtgacgttcccagggagacggtggccgggctgccctggccccagtgctccaagcacttgtcgacgtctcctaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtctcctaatatgctgctgagcgggctggcaaggc

SEQ ID NO: 2690 - DNA, 495 bp, Artificial Sequence
  source: /note="Description of Artificial Sequence: Synthetic polynucleotide"
gcctccctcgcgccatcaggtctcctaaatcctgcccagccacacagacccccgggctgagacccaggcagggaggggtgacgttcccagggagacggtggccgggctgccctggccccagtgctccaagcacttgtcgacgtctcctaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtctcctaaatcctgcctgagcgggctggcaaggc

SEQ ID NO: 2691 - DNA, 495 bp, Artificial Sequence
  source: /note="Description of Artificial Sequence: Synthetic polynucleotide"
gcctccctcgcgccatcaggtctcctatgagacctccagccacacagacccccgggctgagacccaggcagggaggggtgacgttcccagggagacggtggccgggctgccctggccccagtgctccaagcacttgtcgacgtctcctatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtctcctatgagacctctgagcgggctggcaaggc

SEQ ID NO: 2692 - DNA, 495 bp, Artificial Sequence
  source: /note="Description of Artificial Sequence: Synthetic polynucleotide"
gcctccctcgcgccatcaggtctcctagaatggacccagccacacagacccccgggctgagacccaggcagggaggggtgacgttcccagggagacggtggccgggctgccctggccccagtgctccaagcacttgtcgacgtctcctagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtctcctagaatggacctgagcgggctggcaaggc

SEQ ID NO: 2693 - DNA, 495 bp, Artificial Sequence
  source: /note="Description of Artificial Sequence: Synthetic polynucleotide"
gcctccctcgcgccatcaggtctcctacacatggaccagccacacagacccccgggctgagacccaggcagggaggggtgacgttcccagggagacggtggccgggctgccctggccccagtgctccaagcacttgtcgacgtctcctacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtctcctacacatggactgagcgggctggcaaggc

SEQ ID NO: 2694 - DNA, 495 bp, Artificial Sequence
  source: /note="Description of Artificial Sequence: Synthetic polynucleotide"
gcctccctcgcgccatcaggtctcctattgaccatccagccacacagacccccgggctgagacccaggcagggaggggtgacgttcccagggagacggtggccgggctgccctggccccagtgctccaagcacttgtcgacgtctcctattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtctcctattgaccatctgagcgggctggcaaggc

SEQ ID NO: 2695 - DNA, 495 bp, Artificial Sequence
  source: /note="Description of Artificial Sequence: Synthetic polynucleotide"
gcctccctcgcgccatcaggtctcctaaagccatcccagccacacagacccccgggctgagacccaggcagggaggggtgacgttcccagggagacggtggccgggctgccctggccccagtgctccaagcacttgtcgacgtctcctaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtctcctaaagccatcctgagcgggctggcaaggc

SEQ ID NO: 2696 - DNA, 495 bp, Artificial Sequence
  source: /note="Description of Artificial Sequence: Synthetic polynucleotide"
gcctccctcgcgccatcaggtctcctatccatgtgccagccacacagacccccgggctgagacccaggcagggaggggtgacgttcccagggagacggtggccgggctgccctggccccagtgctccaagcacttgtcgacgtctcctatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctatccatgtgctgagcgggctggcaaggc

SEQ ID NO: 2697 - DNA, 495 bp, Artificial Sequence
  source: /note="Description of Artificial Sequence: Synthetic polynucleotide"
gcctccctcgcgccatcaggtctcctacaagtcacccagccacacagacccccgggctgagacccaggcagggaggggtgacgttcccagggagacggtggccgggctgccctggccccagtgctccaagcacttgtcgacgtctcctacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctacaagtcacctgagcgggctggcaaggc

SEQ ID NO: 2698 - DNA, 495 bp, Artificial Sequence
  source: /note="Description of Artificial Sequence: Synthetic polynucleotide"
gcctccctcgcgccatcaggtctcctactgcaatcccagccacacagacccccgggctgagacccaggcagggaggggtgacgttcccagggagacggtggccgggctgccctggccccagtgctccaagcacttgtcgacgtctcctactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtctcctactgcaatcctgagcgggctggcaaggc

SEQ ID NO: 2699 - DNA, 495 bp, Artificial Sequence
  source: /note="Description of Artificial Sequence: Synthetic polynucleotide"
gcctccctcgcgccatcaggtctcctaatcgacgaccagccacacagacccccgggctgagacccaggcagggaggggtgacgttcccagggagacggtggccgggctgccctggccccagtgctccaagcacttgtcgacgtctcctaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtctcctaatcgacgactgagcgggctggcaaggc

SEQ ID NO: 2700 - DNA, 495 bp, Artificial Sequence
  source: /note="Description of Artificial Sequence: Synthetic polynucleotide"
gcctccctcgcgccatcaggtctcctaacagactgccagccacacagacccccgggctgagacccaggcagggaggggtgacgttcccagggagacggtggccgggctgccctggccccagtgctccaagcacttgtcgacgtctcctaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtctcctaacagactgctgagcgggctggcaaggc

SEQ ID NO: 2701 - DNA, 495 bp, Artificial Sequence
  source: /note="Description of Artificial Sequence: Synthetic polynucleotide"
gcctccctcgcgccatcaggtctcctaccttatagccagccacacagacccccgggctgagacccaggcagggaggggtgacgttcccagggagacggtggccgggctgccctggccccagtgctccaagcacttgtcgacgtctcctaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtctcctaccttatagctgagcgggctggcaaggc

SEQ ID NO: 2702 - DNA, 495 bp, Artificial Sequence
  source: /note="Description of Artificial Sequence: Synthetic polynucleotide"
gcctccctcgcgccatcaggtctcctatacgcgttccagccacacagacccccgggctgagacccaggcagggaggggtgacgttcccagggagacggtggccgggctgccctggccccagtgctccaagcacttgtcgacgtctcctatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtctcctatacgcgttctgagcgggctggcaaggc

SEQ ID NO: 2703 - DNA, 495 bp, Artificial Sequence
  source: /note="Description of Artificial Sequence: Synthetic polynucleotide"
gcctccctcgcgccatcaggtctcctactataaggccagccacacagacccccgggctgagacccaggcagggaggggtgacgttcccagggagacggtggccgggctgccctggccccagtgctccaagcacttgtcgacgtctcctactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtctcctactataaggctgagcgggctggcaaggc

SEQ ID NO: 2704 - DNA, 495 bp, Artificial Sequence
  source: /note="Description of Artificial Sequence: Synthetic polynucleotide"
gcctccctcgcgccatcaggtctcctatcttagtcccagccacacagacccccgggctgagacccaggcagggaggggtgacgttcccagggagacggtggccgggctgccctggccccagtgctccaagcacttgtcgacgtctcctatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctatcttagtcctgagcgggctggcaaggc

SEQ ID NO: 2705 - DNA, 495 bp, Artificial Sequence
  source: /note="Description of Artificial Sequence: Synthetic polynucleotide"
gcctccctcgcgccatcaggtctcctatgtctgcaccagccacacagacccccgggctgagacccaggcagggaggggtgacgttcccagggagacggtggccgggctgccctggccccagtgctccaagcacttgtcgacgtctcctatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtctcctatgtctgcactgagcgggctggcaaggc

SEQ ID NO: 2706 - DNA, 495 bp, Artificial Sequence
  source: /note="Description of Artificial Sequence: Synthetic polynucleotide"
gcctccctcgcgccatcaggtctcctagccattaaccagccacacagacccccgggctgagacccaggcagggaggggtgacgttcccagggagacggtggccgggctgccctggccccagtgctccaagcacttgtcgacgtctcctagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctagccattaactgagcgggctggcaaggc

SEQ ID NO: 2707 - DNA, 495 bp, Artificial Sequence
  source: /note="Description of Artificial Sequence: Synthetic polynucleotide"
gcctccctcgcgccatcaggtctcctagactaagaccagccacacagacccccgggctgagacccaggcagggaggggtgacgttcccagggagacggtggccgggctgccctggccccagtgctccaagcacttgtcgacgtctcctagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtctcctagactaagactgagcgggctggcaaggc

SEQ ID NO: 2708 - DNA, 495 bp, Artificial Sequence
  source: /note="Description of Artificial Sequence: Synthetic polynucleotide"
gcctccctcgcgccatcaggtctcctaaggttgctccagccacacagacccccgggctgagacccaggcagggaggggtgacgttcccagggagacggtggccgggctgccctggccccagtgctccaagcacttgtcgacgtctcctaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtctcctaaggttgctctgagcgggctggcaaggc

SEQ ID NO: 2709 - DNA, 495 bp, Artificial Sequence
  source: /note="Description of Artificial Sequence: Synthetic polynucleotide"
gcctccctcgcgccatcaggtctcctactcgagaaccagccacacagacccccgggctgagacccaggcagggaggggtgacgttcccagggagacggtggccgggctgccctggccccagtgctccaagcacttgtcgacgtctcctactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtctcctactcgagaactgagcgggctggcaaggc

SEQ ID NO: 2710 - DNA, 495 bp, Artificial Sequence
  source: /note="Description of Artificial Sequence: Synthetic polynucleotide"
gcctccctcgcgccatcaggtctcctattaatggcccagccacacagacccccgggctgagacccaggcagggaggggtgacgttcccagggagacggtggccgggctgccctggccccagtgctccaagcacttgtcgacgtctcctattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtctcctattaatggcctgagcgggctggcaaggc

SEQ ID NO: 2711 - DNA, 495 bp, Artificial Sequence
  source: /note="Description of Artificial Sequence: Synthetic polynucleotide"
gcctccctcgcgccatcaggtctcctatgcagacaccagccacacagacccccgggctgagacccaggcagggaggggtgacgttcccagggagacggtggccgggctgccctggccccagtgctccaagcacttgtcgacgtctcctatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtctcctatgcagacactgagcgggctggcaaggc

SEQ ID NO: 2712 - DNA, 495 bp, Artificial Sequence
  source: /note="Description of Artificial Sequence: Synthetic polynucleotide"
gcctccctcgcgccatcaggtctcctatcactgagccagccacacagacccccgggctgagacccaggcagggaggggtgacgttcccagggagacggtggccgggctgccctggccccagtgctccaagcacttgtcgacgtctcctatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtctcctatcactgagctgagcgggctggcaaggc

SEQ ID NO: 2713 - DNA, 495 bp, Artificial Sequence
  source: /note="Description of Artificial Sequence: Synthetic polynucleotide"
gcctccctcgcgccatcaggtctcctagagtacgtccagccacacagacccccgggctgagacccaggcagggaggggtgacgttcccagggagacggtggccgggctgccctggccccagtgctccaagcacttgtcgacgtctcctagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtctcctagagtacgtctgagcgggctggcaaggc

SEQ ID NO: 2714 - DNA, 495 bp, Artificial Sequence
  source: /note="Description of Artificial Sequence: Synthetic polynucleotide"
gcctccctcgcgccatcaggtctcctaatacgccaccagccacacagacccccgggctgagacccaggcagggaggggtgacgttcccagggagacggtggccgggctgccctggccccagtgctccaagcacttgtcgacgtctcctaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtctcctaatacgccactgagcgggctggcaaggc

SEQ ID NO: 2715 - DNA, 495 bp, Artificial Sequence
  source: /note="Description of Artificial Sequence: Synthetic polynucleotide"
gcctccctcgcgccatcaggtctcctatcgcatcaccagccacacagacccccgggctgagacccaggcagggaggggtgacgttcccagggagacggtggccgggctgccctggccccagtgctccaagcacttgtcgacgtctcctatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtctcctatcgcatcactgagcgggctggcaaggc

SEQ ID NO: 2716 - DNA, 495 bp, Artificial Sequence
  source: /note="Description of Artificial Sequence: Synthetic polynucleotide"
gcctccctcgcgccatcaggtctcctacgcttaatccagccacacagacccccgggctgagacccaggcagggaggggtgacgttcccagggagacggtggccgggctgccctggccccagtgctccaagcacttgtcgacgtctcctacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtctcctacgcttaatctgagcgggctggcaaggc

SEQ ID NO: 2717 - DNA, 495 bp, Artificial Sequence
  source: /note="Description of Artificial Sequence: Synthetic polynucleotide"
gcctccctcgcgccatcaggtctcctatggttatcccagccacacagacccccgggctgagacccaggcagggaggggtgacgttcccagggagacggtggccgggctgccctggccccagtgctccaagcacttgtcgacgtctcctatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtctcctatggttatcctgagcgggctggcaaggc

SEQ ID NO: 2718 - DNA, 495 bp, Artificial Sequence
  source: /note="Description of Artificial Sequence: Synthetic polynucleotide"
gcctccctcgcgccatcaggtctcctaggattgctccagccacacagacccccgggctgagacccaggcagggaggggtgacgttcccagggagacggtggccgggctgccctggccccagtgctccaagcacttgtcgacgtctcctaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtctcctaggattgctctgagcgggctggcaaggc

SEQ ID NO: 2719 - DNA, 495 bp, Artificial Sequence
  source: /note="Description of Artificial Sequence: Synthetic polynucleotide"
gcctccctcgcgccatcaggtctcctactcagtgaccagccacacagacccccgggctgagacccaggcagggaggggtgacgttcccagggagacggtggccgggctgccctggccccagtgctccaagcacttgtcgacgtctcctactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtctcctactcagtgactgagcgggctggcaaggc

SEQ ID NO: 2720 - DNA, 495 bp, Artificial Sequence
  source: /note="Description of Artificial Sequence: Synthetic polynucleotide"
gcctccctcgcgccatcaggtctcctaacgtactcccagccacacagacccccgggctgagacccaggcagggaggggtgacgttcccagggagacggtggccgggctgccctggccccagtgctccaagcacttgtcgacgtctcctaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtctcctaacgtactcctgagcgggctggcaaggc

SEQ ID NO: 2721 - DNA, 495 bp, Artificial Sequence
  source: /note="Description of Artificial Sequence: Synthetic polynucleotide"
gcctccctcgcgccatcaggtctcctatgatgcgaccagccacacagacccccgggctgagacccaggcagggaggggtgacgttcccagggagacggtggccgggctgccctggccccagtgctccaagcacttgtcgacgtctcctatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtctcctatgatgcgactgagcgggctggcaaggc

SEQ ID NO: 2722 - DNA, 495 bp, Artificial Sequence
  source: /note="Description of Artificial Sequence: Synthetic polynucleotide"
gcctccctcgcgccatcaggtctcctaattaagcgccagccacacagacccccgggctgagacccaggcagggaggggtgacgttcccagggagacggtggccgggctgccctggccccagtgctccaagcacttgtcgacgtctcctaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtctcctaattaagcgctgagcgggctggcaaggc

SEQ ID NO: 2723 - DNA, 495 bp, Artificial Sequence
  source: /note="Description of Artificial Sequence: Synthetic polynucleotide"
gcctccctcgcgccatcaggtctcctaagcaatccccagccacacagacccccgggctgagacccaggcagggaggggtgacgttcccagggagacggtggccgggctgccctggccccagtgctccaagcacttgtcgacgtctcctaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtctcctaagcaatccctgagcgggctggcaaggc

SEQ ID NO: 2724 - DNA, 495 bp, Artificial Sequence
  source: /note="Description of Artificial Sequence: Synthetic polynucleotide"
gcctccctcgcgccatcaggtctcctagcttagtaccagccacacagacccccgggctgagacccaggcagggaggggtgacgttcccagggagacggtggccgggctgccctggccccagtgctccaagcacttgtcgacgtctcctagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtctcctagcttagtactgagcgggctggcaaggc

SEQ ID NO: 2725 - DNA, 495 bp, Artificial Sequence
  source: /note="Description of Artificial Sequence: Synthetic polynucleotide"
gcctccctcgcgccatcaggtctcctatgaccttgccagccacacagacccccgggctgagacccaggcagggaggggtgacgttcccagggagacggtggccgggctgccctggccccagtgctccaagcacttgtcgacgtctcctatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtctcctatgaccttgctgagcgggctggcaaggc

SEQ ID NO: 2726 - DNA, 495 bp, Artificial Sequence
  source: /note="Description of Artificial Sequence: Synthetic polynucleotide"
gcctccctcgcgccatcaggtctcctacaaggtcaccagccacacagacccccgggctgagacccaggcagggaggggtgacgttcccagggagacggtggccgggctgccctggccccagtgctccaagcacttgtcgacgtctcctacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtctcctacaaggtcactgagcgggctggcaaggc

SEQ ID NO: 2727 - DNA, 495 bp, Artificial Sequence
  source: /note="Description of Artificial Sequence: Synthetic polynucleotide"
gcctccctcgcgccatcaggtctcctacactgtacccagccacacagacccccgggctgagacccaggcagggaggggtgacgttcccagggagacggtggccgggctgccctggccccagtgctccaagcacttgtcgacgtctcctacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtctcctacactgtacctgagcgggctggcaaggc

SEQ ID NO: 2728 - DNA, 495 bp, Artificial Sequence
  source: /note="Description of Artificial Sequence: Synthetic polynucleotide"
gcctccctcgcgccatcaggtctcctagatgatccccagccacacagacccccgggctgagacccaggcagggaggggtgacgttcccagggagacggtggccgggctgccctggccccagtgctccaagcacttgtcgacgtctcctagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtctcctagatgatccctgagcgggctggcaaggc

SEQ ID NO: 2729 - DNA, 495 bp, Artificial Sequence
  source: /note="Description of Artificial Sequence: Synthetic polynucleotide"
gcctccctcgcgccatcaggtctcctacgccaataccagccacacagacccccgggctgagacccaggcagggaggggtgacgttcccagggagacggtggccgggctgccctggccccagtgctccaagcacttgtcgacgtctcctacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtctcctacgccaatactgagcgggctggcaaggc

SEQ ID NO: 2730 - DNA, 495 bp, Artificial Sequence
  source: /note="Description of Artificial Sequence: Synthetic polynucleotide"
gcctccctcgcgccatcaggtctcctatcaagcctccagccacacagacccccgggctgagacccaggcagggaggggtgacgttcccagggagacggtggccgggctgccctggccccagtgctccaagcacttgtcgacgtctcctatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtctcctatcaagcctctgagcgggctggcaaggc

SEQ ID NO: 2731 - DNA, 495 bp, Artificial Sequence
  source: /note="Description of Artificial Sequence: Synthetic polynucleotide"
gcctccctcgcgccatcaggtctcctaacgtgtgtccagccacacagacccccgggctgagacccaggcagggaggggtgacgttcccagggagacggtggccgggctgccctggccccagtgctccaagcacttgtcgacgtctcctaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtctcctaacgtgtgtctgagcgggctggcaaggc

SEQ ID NO: 2732 - DNA, 495 bp, Artificial Sequence
  source: /note="Description of Artificial Sequence: Synthetic polynucleotide"
gcctccctcgcgccatcaggtctcctatccgtctaccagccacacagacccccgggctgagacccaggcagggaggggtgacgttcccagggagacggtggccgggctgccctggccccagtgctccaagcacttgtcgacgtctcctatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtctcctatccgtctactgagcgggctggcaaggc

SEQ ID NO: 2733 - DNA, 495 bp, Artificial Sequence
  source: /note="Description of Artificial Sequence: Synthetic polynucleotide"
gcctccctcgcgccatcaggtctcctaaagagctgccagccacacagacccccgggctgagacccaggcagggaggggtgacgttcccagggagacggtggccgggctgccctggccccagtgctccaagcacttgtcgacgtctcctaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtctcctaaagagctgctgagcgggctggcaaggc

SEQ ID NO: 2734 - DNA, 495 bp, Artificial Sequence
  source: /note="Description of Artificial Sequence: Synthetic polynucleotide"
gcctccctcgcgccatcaggtctcctatatcgctcccagccacacagacccccgggctgagacccaggcagggaggggtgacgttcccagggagacggtggccgggctgccctggccccagtgctccaagcacttgtcgacgtctcctatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtctcctatatcgctcctgagcgggctggcaaggc

SEQ ID NO: 2735 - DNA, 495 bp, Artificial Sequence
  source: /note="Description of Artificial Sequence: Synthetic polynucleotide"
gcctccctcgcgccatcaggtctcctatcagatgcccagccacacagacccccgggctgagacccaggcagggaggggtgacgttcccagggagacggtggccgggctgccctggccccagtgctccaagcacttgtcgacgtctcctatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtctcctatcagatgcctgagcgggctggcaaggc

SEQ ID NO: 2736 - DNA, 495 bp, Artificial Sequence
  source: /note="Description of Artificial Sequence: Synthetic polynucleotide"
gcctccctcgcgccatcaggtctcctagtgtagcaccagccacacagacccccgggctgagacccaggcagggaggggtgacgttcccagggagacggtggccgggctgccctggccccagtgctccaagcacttgtcgacgtctcctagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtctcctagtgtagcactgagcgggctggcaaggc

SEQ ID NO: 2737 - DNA, 495 bp, Artificial Sequence
  source: /note="Description of Artificial Sequence: Synthetic polynucleotide"
gcctccctcgcgccatcaggtctcctatggcagttccagccacacagacccccgggctgagacccaggcagggaggggtgacgttcccagggagacggtggccgggctgccctggccccagtgctccaagcacttgtcgacgtctcctatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtctcctatggcagttctgagcgggctggcaaggc

SEQ ID NO: 2738 - DNA, 495 bp, Artificial Sequence
  source: /note="Description of Artificial Sequence: Synthetic polynucleotide"
gcctccctcgcgccatcaggtctcctacagtccaaccagccacacagacccccgggctgagacccaggcagggaggggtgacgttcccagggagacggtggccgggctgccctggccccagtgctccaagcacttgtcgacgtctcctacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtctcctacagtccaactgagcgggctggcaaggc

SEQ ID NO: 2739 - DNA, 495 bp, Artificial Sequence
  source: /note="Description of Artificial Sequence: Synthetic polynucleotide"
gcctccctcgcgccatcaggtctcctagtgtctacccagccacacagacccccgggctgagacccaggcagggaggggtgacgttcccagggagacggtggccgggctgccctggccccagtgctccaagcacttgtcgacgtctcctagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtctcctagtgtctacctgagcgggctggcaaggc

SEQ ID NO: 2740 - DNA, 495 bp, Artificial Sequence
  source: /note="Description of Artificial Sequence: Synthetic polynucleotide"
gcctccctcgcgccatcaggtctcctagtacagtgccagccacacagacccccgggctgagacccaggcagggaggggtgacgttcccagggagacggtggccgggctgccctggccccagtgctccaagcacttgtcgacgtctcctagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtctcctagtacagtgctgagcgggctggcaaggc

SEQ ID NO: 2741 - DNA, 495 bp, Artificial Sequence
  source: /note="Description of Artificial Sequence: Synthetic polynucleotide"
gcctccctcgcgccatcaggtctcctaggatcatcccagccacacagacccccgggctgagacccaggcagggaggggtgacgttcccagggagacggtggccgggctgccctggccccagtgctccaagcacttgtcgacgtctcctaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtctcctaggatcatcctgagcgggctggcaaggc

SEQ ID NO: 2742 - DNA, 495 bp, Artificial Sequence
  source: /note="Description of Artificial Sequence: Synthetic polynucleotide"
gcctccctcgcgccatcaggtctcctatattggcgccagccacacagacccccgggctgagacccaggcagggaggggtgacgttcccagggagacggtggccgggctgccctggccccagtgctccaagcacttgtcgacgtctcctatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtctcctatattggcgctgagcgggctggcaaggc

SEQ ID NO: 2743 - DNA, 495 bp, Artificial Sequence
  source: /note="Description of Artificial Sequence: Synthetic polynucleotide"
gcctccctcgcgccatcaggtctcctaaggcttgaccagccacacagacccccgggctgagacccaggcagggaggggtgacgttcccagggagacggtggccgggctgccctggccccagtgctccaagcacttgtcgacgtctcctaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtctcctaaggcttgactgagcgggctggcaaggc

SEQ ID NO: 2744 - DNA, 495 bp, Artificial Sequence
  source: /note="Description of Artificial Sequence: Synthetic polynucleotide"
gcctccctcgcgccatcaggtctcctaacacacgtccagccacacagacccccgggctgagacccaggcagggaggggtgacgttcccagggagacggtggccgggctgccctggccccagtgctccaagcacttgtcgacgtctcctaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtctcctaacacacgtctgagcgggctggcaaggc

SEQ ID NO: 2745 - DNA, 495 bp, Artificial Sequence
  source: /note="Description of Artificial Sequence: Synthetic polynucleotide"
gcctccctcgcgccatcaggtctcctatagacggaccagccacacagacccccgggctgagacccaggcagggaggggtgacgttcccagggagacggtggccgggctgccctggccccagtgctccaagcacttgtcgacgtctcctatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtctcctatagacggactgagcgggctggcaaggc

SEQ ID NO: 2746 - DNA, 495 bp, Artificial Sequence
  source: /note="Description of Artificial Sequence: Synthetic polynucleotide"
gcctccctcgcgccatcaggtctcctagagcgataccagccacacagacccccgggctgagacccaggcagggaggggtgacgttcccagggagacggtggccgggctgccctggccccagtgctccaagcacttgtcgacgtctcctagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtctcctagagcgatactgagcgggctggcaaggc

SEQ ID NO: 2747 - DNA, 495 bp, Artificial Sequence
  source: /note="Description of Artificial Sequence: Synthetic polynucleotide"
gcctccctcgcgccatcaggtctcctagcatctgaccagccacacagacccccgggctgagacccaggcagggaggggtgacgttcccagggagacggtggccgggctgccctggccccagtgctccaagcacttgtcgacgtctcctagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtctcctagcatctgactgagcgggctggcaaggc

SEQ ID NO: 2748 - DNA, 495 bp, Artificial Sequence
  source: /note="Description of Artificial Sequence: Synthetic polynucleotide"
gcctccctcgcgccatcaggtctcctatgctacacccagccacacagacccccgggctgagacccaggcagggaggggtgacgttcccagggagacggtggccgggctgccctggccccagtgctccaagcacttgtcgacgtctcctatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtctcctatgctacacctgagcgggctggcaaggc

SEQ ID NO: 2749 - DNA, 495 bp, Artificial Sequence
  source: /note="Description of Artificial Sequence: Synthetic polynucleotide"
gcctccctcgcgccatcaggtctcctaaactgccaccagccacacagacccccgggctgagacccaggcagggaggggtgacgttcccagggagacggtggccgggctgccctggccccagtgctccaagcacttgtcgacgtctcctaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtctcctaaactgccactgagcgggctggcaaggc

SEQ ID NO: 2750 - DNA, 495 bp, Artificial Sequence
  source: /note="Description of Artificial Sequence: Synthetic polynucleotide"
gcctccctcgcgccatcaggtctcctattggactgccagccacacagacccccgggctgagacccaggcagggaggggtgacgttcccagggagacggtggccgggctgccctggccccagtgctccaagcacttgtcgacgtctcctattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtctcctattggactgctgagcgggctggcaaggc

SEQ ID NO: 2751 - DNA, 495 bp, Artificial Sequence
  source: /note="Description of Artificial Sequence: Synthetic polynucleotide"
gcctccctcgcgccatcaggtctcctatcggtactccagccacacagacccccgggctgagacccaggcagggaggggtgacgttcccagggagacggtggccgggctgccctggccccagtgctccaagcacttgtcgacgtctcctatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtctcctatcggtactctgagcgggctggcaaggc

SEQ ID NO: 2752 - DNA, 495 bp, Artificial Sequence
  source: /note="Description of Artificial Sequence: Synthetic polynucleotide"
gcctccctcgcgccatcaggtctcctaccatggatccagccacacagacccccgggctgagacccaggcagggaggggtgacgttcccagggagacggtggccgggctgccctggccccagtgctccaagcacttgtcgacgtctcctaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtctcctaccatggatctgagcgggctggcaaggc

SEQ ID NO: 2753 - DNA, 495 bp, Artificial Sequence
  source: /note="Description of Artificial Sequence: Synthetic polynucleotide"
gcctccctcgcgccatcaggtctcctaacgaagatccagccacacagacccccgggctgagacccaggcagggaggggtgacgttcccagggagacggtggccgggctgccctggccccagtgctccaagcacttgtcgacgtctcctaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtctcctaacgaagatctgagcgggctggcaaggc

SEQ ID NO: 2754 - DNA, 495 bp, Artificial Sequence
  source: /note="Description of Artificial Sequence: Synthetic polynucleotide"
gcctccctcgcgccatcaggtctcctaactgtggaccagccacacagacccccgggctgagacccaggcagggaggggtgacgttcccagggagacggtggccgggctgccctggccccagtgctccaagcacttgtcgacgtctcctaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtctcctaactgtggactgagcgggctggcaaggc

SEQ ID NO: 2755 - DNA, 495 bp, Artificial Sequence
  source: /note="Description of Artificial Sequence: Synthetic polynucleotide"
gcctccctcgcgccatcaggtctcctaggtgtcatccagccacacagacccccgggctgagacccaggcagggaggggtgacgttcccagggagacggtggccgggctgccctggccccagtgctccaagcacttgtcgacgtctcctaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtctcctaggtgtcatctgagcgggctggcaaggc

SEQ ID NO: 2756 - DNA, 495 bp, Artificial Sequence
  source: /note="Description of Artificial Sequence: Synthetic polynucleotide"
gcctccctcgcgccatcaggtctcctatcgtgaagccagccacacagacccccgggctgagacccaggcagggaggggtgacgttcccagggagacggtggccgggctgccctggccccagtgctccaagcacttgtcgacgtctcctatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtctcctatcgtgaagctgagcgggctggcaaggc

SEQ ID NO: 2757 - DNA, 495 bp, Artificial Sequence
  source: /note="Description of Artificial Sequence: Synthetic polynucleotide"
gcctccctcgcgccatcaggtctcctacactagctccagccacacagacccccgggctgagacccaggcagggaggggtgacgttcccagggagacggtggccgggctgccctggccccagtgctccaagcacttgtcgacgtctcctacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtctcctacactagctctgagcgggctggcaaggc

SEQ ID NO: 2758 - DNA, 495 bp, Artificial Sequence
  source: /note="Description of Artificial Sequence: Synthetic polynucleotide"
gcctccctcgcgccatcaggtctcctaggtcaactccagccacacagacccccgggctgagacccaggcagggaggggtgacgttcccagggagacggtggccgggctgccctggccccagtgctccaagcacttgtcgacgtctcctaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtctcctaggtcaactctgagcgggctggcaaggc

SEQ ID NO: 2759 - DNA, 495 bp, Artificial Sequence
  source: /note="Description of Artificial Sequence: Synthetic polynucleotide"
gcctccctcgcgccatcaggtctcctatacgtacgccagccacacagacccccgggctgagacccaggcagggaggggtgacgttcccagggagacggtggccgggctgccctggccccagtgctccaagcacttgtcgacgtctcctatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtctcctatacgtacgctgagcgggctggcaaggc

SEQ ID NO: 2760 - DNA, 495 bp, Artificial Sequence
  source: /note="Description of Artificial Sequence: Synthetic polynucleotide"
gcctccctcgcgccatcaggtctcctaatgacaccccagccacacagacccccgggctgagacccaggcagggaggggtgacgttcccagggagacggtggccgggctgccctggccccagtgctccaagcacttgtcgacgtctcctaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtctcctaatgacaccctgagcgggctggcaaggc

SEQ ID NO: 2761 - DNA, 495 bp, Artificial Sequence
  source: /note="Description of Artificial Sequence: Synthetic polynucleotide"
gcctccctcgcgccatcaggtctcctacttcacgaccagccacacagacccccgggctgagacccaggcagggaggggtgacgttcccagggagacggtggccgggctgccctggccccagtgctccaagcacttgtcgacgtctcctacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtctcctacttcacgactgagcgggctggcaaggc

SEQ ID NO: 2762 - DNA, 495 bp, Artificial Sequence
  source: /note="Description of Artificial Sequence: Synthetic polynucleotide"
gcctccctcgcgccatcaggtctcctaagaatcagccagccacacagacccccgggctgagacccaggcagggaggggtgacgttcccagggagacggtggccgggctgccctggccccagtgctccaagcacttgtcgacgtctcctaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtctcctaagaatcagctgagcgggctggcaaggc

SEQ ID NO: 2763 - DNA, 495 bp, Artificial Sequence
  source: /note="Description of Artificial Sequence: Synthetic polynucleotide"
gcctccctcgcgccatcaggtctcctaagttatgcccagccacacagacccccgggctgagacccaggcagggaggggtgacgttcccagggagacggtggccgggctgccctggccccagtgctccaagcacttgtcgacgtctcctaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtctcctaagttatgcctgagcgggctggcaaggc

SEQ ID NO: 2764 - DNA, 495 bp, Artificial Sequence
  source: /note="Description of Artificial Sequence: Synthetic polynucleotide"
gcctccctcgcgccatcaggtctcctaaggtctcaccagccacacagacccccgggctgagacccaggcagggaggggtgacgttcccagggagacggtggccgggctgccctggccccagtgctccaagcacttgtcgacgtctcctaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtctcctaaggtctcactgagcgggctggcaaggc

SEQ ID NO: 2765 - DNA, 495 bp, Artificial Sequence
  source: /note="Description of Artificial Sequence: Synthetic polynucleotide"
gcctccctcgcgccatcaggtctcctagtcatagtccagccacacagacccccgggctgagacccaggcagggaggggtgacgttcccagggagacggtggccgggctgccctggccccagtgctccaagcacttgtcgacgtctcctagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtctcctagtcatagtctgagcgggctggcaaggc

SEQ ID NO: 2766 - DNA, 495 bp, Artificial Sequence
  source: /note="Description of Artificial Sequence: Synthetic polynucleotide"
gcctccctcgcgccatcaggtctcctagtgacttgccagccacacagacccccgggctgagacccaggcagggaggggtgacgttcccagggagacggtggccgggctgccctggccccagtgctccaagcacttgtcgacgtctcctagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtctcctagtgacttgctgagcgggctggcaaggc

SEQ ID NO: 2767 - DNA, 495 bp, Artificial Sequence
  source: /note="Description of Artificial Sequence: Synthetic polynucleotide"
gcctccctcgcgccatcaggtctcctagattgcagccagccacacagacccccgggctgagacccaggcagggaggggtgacgttcccagggagacggtggccgggctgccctggccccagtgctccaagcacttgtcgacgtctcctagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtctcctagattgcagctgagcgggctggcaaggc

SEQ ID NO: 2768 - DNA, 495 bp, Artificial Sequence
  source: /note="Description of Artificial Sequence: Synthetic polynucleotide"
gcctccctcgcgccatcaggtctcctaactatgacccagccacacagacccccgggctgagacccaggcagggaggggtgacgttcccagggagacggtggccgggctgccctggccccagtgctccaagcacttgtcgacgtctcctaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtctcctaactatgacctgagcgggctggcaaggc

SEQ ID NO: 2769 - DNA, 495 bp, Artificial Sequence
  source: /note="Description of Artificial Sequence: Synthetic polynucleotide"
gcctccctcgcgccatcaggtctcctaatggtcaaccagccacacagacccccgggctgagacccaggcagggaggggtgacgttcccagggagacggtggccgggctgccctggccccagtgctccaagcacttgtcgacgtctcctaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtctcctaatggtcaactgagcgggctggcaaggc

SEQ ID NO: 2770 - DNA, 495 bp, Artificial Sequence
  source: /note="Description of Artificial Sequence: Synthetic polynucleotide"
gcctccctcgcgccatcaggtctcctagatggcttccagccacacagacccccgggctgagacccaggcagggaggggtgacgttcccagggagacggtggccgggctgccctggccccagtgctccaagcacttgtcgacgtctcctagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtctcctagatggcttctgagcgggctggcaaggc

SEQ ID NO: 2771 - DNA, 495 bp, Artificial Sequence
  source: /note="Description of Artificial Sequence: Synthetic polynucleotide"
gcctccctcgcgccatcaggtctcctaagcatatgccagccacacagacccccgggctgagacccaggcagggaggggtgacgttcccagggagacggtggccgggctgccctggccccagtgctccaagcacttgtcgacgtctcctaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtctcctaagcatatgctgagcgggctggcaaggc

SEQ ID NO: 2772 - DNA, 495 bp, Artificial Sequence
  source: /note="Description of Artificial Sequence: Synthetic polynucleotide"
gcctccctcgcgccatcaggtctcctacatatgctccagccacacagacccccgggctgagacccaggcagggaggggtgacgttcccagggagacggtggccgggctgccctggccccagtgctccaagcacttgtcgacgtctcctacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtctcctacatatgctctgagcgggctggcaaggc

SEQ ID NO: 2773 - DNA, 495 bp, Artificial Sequence
  source: /note="Description of Artificial Sequence: Synthetic polynucleotide"
gcctccctcgcgccatcaggtctcctatcgtcgatccagccacacagacccccgggctgagacccaggcagggaggggtgacgttcccagggagacggtggccgggctgccctggccccagtgctccaagcacttgtcgacgtctcctatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtctcctatcgtcgatctgagcgggctggcaaggc

SEQ ID NO: 2774 - DNA, 495 bp, Artificial Sequence
  source: /note="Description of Artificial Sequence: Synthetic polynucleotide"
gcctccctcgcgccatcaggtctcctacagtctgtccagccacacagacccccgggctgagacccaggcagggaggggtgacgttcccagggagacggtggccgggctgccctggccccagtgctccaagcacttgtcgacgtctcctacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtctcctacagtctgtctgagcgggctggcaaggc

SEQ ID NO: 2775 - DNA, 495 bp, Artificial Sequence
  source: /note="Description of Artificial Sequence: Synthetic polynucleotide"
gcctccctcgcgccatcaggtctcctaaacgcgtaccagccacacagacccccgggctgagacccaggcagggaggggtgacgttcccagggagacggtggccgggctgccctggccccagtgctccaagcacttgtcgacgtctcctaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtctcctaaacgcgtactgagcgggctggcaaggc

SEQ ID NO: 2776 - DNA, 495 bp, Artificial Sequence
  source: /note="Description of Artificial Sequence: Synthetic polynucleotide"
gcctccctcgcgccatcaggtctcctagtagttcgccagccacacagacccccgggctgagacccaggcagggaggggtgacgttcccagggagacggtggccgggctgccctggccccagtgctccaagcacttgtcgacgtctcctagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtctcctagtagttcgctgagcgggctggcaaggc

SEQ ID NO: 2777 - DNA, 495 bp, Artificial Sequence
  source: /note="Description of Artificial Sequence: Synthetic polynucleotide"
gcctccctcgcgccatcaggtctcctacgaactacccagccacacagacccccgggctgagacccaggcagggaggggtgacgttcccagggagacggtggccgggctgccctggccccagtgctccaagcacttgtcgacgtctcctacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtctcctacgaactacctgagcgggctggcaaggc

SEQ ID NO: 2778 - DNA, 495 bp, Artificial Sequence
  source: /note="Description of Artificial Sequence: Synthetic polynucleotide"
gcctccctcgcgccatcaggtctcctattaacgtcccagccacacagacccccgggctgagacccaggcagggaggggtgacgttcccagggagacggtggccgggctgccctggccccagtgctccaagcacttgtcgacgtctcctattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtctcctattaacgtcctgagcgggctggcaaggc

SEQ ID NO: 2779 - DNA, 495 bp, Artificial Sequence
  source: /note="Description of Artificial Sequence: Synthetic polynucleotide"
gcctccctcgcgccatcaggtctcctaagcaacctccagccacacagacccccgggctgagacccaggcagggaggggtgacgttcccagggagacggtggccgggctgccctggccccagtgctccaagcacttgtcgacgtctcctaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtctcctaagcaacctctgagcgggctggcaaggc

SEQ ID NO: 2780 - DNA, 495 bp, Artificial Sequence
  source: /note="Description of Artificial Sequence: Synthetic polynucleotide"
gcctccctcgcgccatcaggtctcctattctcgagccagccacacagacccccgggctgagacccaggcagggaggggtgacgttcccagggagacggtggccgggctgccctggccccagtgctccaagcacttgtcgacgtctcctattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtctcctattctcgagctgagcgggctggcaaggc

SEQ ID NO: 2781 - DNA, 495 bp, Artificial Sequence
  source: /note="Description of Artificial Sequence: Synthetic polynucleotide"
gcctccctcgcgccatcaggtctcctaactctacgccagccacacagacccccgggctgagacccaggcagggaggggtgacgttcccagggagacggtggccgggctgccctggccccagtgctccaagcacttgtcgacgtctcctaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtctcctaactctacgctgagcgggctggcaaggc

SEQ ID NO: 2782 - DNA, 495 bp, Artificial Sequence
  source: /note="Description of Artificial Sequence: Synthetic polynucleotide"
gcctccctcgcgccatcaggtctcctataccggaaccagccacacagacccccgggctgagacccaggcagggaggggtgacgttcccagggagacggtggccgggctgccctggccccagtgctccaagcacttgtcgacgtctcctataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtctcctataccggaactgagcgggctggcaaggc

SEQ ID NO: 2783 - DNA, 495 bp, Artificial Sequence
  source: /note="Description of Artificial Sequence: Synthetic polynucleotide"
gcctccctcgcgccatcaggtctcctacgaattgcccagccacacagacccccgggctgagacccaggcagggaggggtgacgttcccagggagacggtggccgggctgccctggccccagtgctccaagcacttgtcgacgtctcctacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtctcctacgaattgcctgagcgggctggcaaggc

SEQ ID NO: 2784 - DNA, 495 bp, Artificial Sequence
  source: /note="Description of Artificial Sequence: Synthetic polynucleotide"
gcctccctcgcgccatcaggtctcctattcgctcaccagccacacagacccccgggctgagacccaggcagggaggggtgacgttcccagggagacggtggccgggctgccctggccccagtgctccaagcacttgtcgacgtctcctattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtctcctattcgctcactgagcgggctggcaaggc

SEQ ID NO: 2785 - DNA, 495 bp, Artificial Sequence
  source: /note="Description of Artificial Sequence: Synthetic polynucleotide"
gcctccctcgcgccatcaggtctcctagacgttaaccagccacacagacccccgggctgagacccaggcagggaggggtgacgttcccagggagacggtggccgggctgccctggccccagtgctccaagcacttgtcgacgtctcctagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtctcctagacgttaactgagcgggctggcaaggc

SEQ ID NO: 2786 - DNA, 495 bp, Artificial Sequence
  source: /note="Description of Artificial Sequence: Synthetic polynucleotide"
gcctccctcgcgccatcaggtctcctacgtagagtccagccacacagacccccgggctgagacccaggcagggaggggtgacgttcccagggagacggtggccgggctgccctggccccagtgctccaagcacttgtcgacgtctcctacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtctcctacgtagagtctgagcgggctggcaaggc

SEQ ID NO: 2787 - DNA, 495 bp, Artificial Sequence
  source: /note="Description of Artificial Sequence: Synthetic polynucleotide"
gcctccctcgcgccatcaggtctcctattccggtaccagccacacagacccccgggctgagacccaggcagggaggggtgacgttcccagggagacggtggccgggctgccctggccccagtgctccaagcacttgtcgacgtctcctattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtctcctattccggtactgagcgggctggcaaggc

SEQ ID NO: 2788 - DNA, 495 bp, Artificial Sequence
  source: /note="Description of Artificial Sequence: Synthetic polynucleotide"
gcctccctcgcgccatcaggtctcctagcaattcgccagccacacagacccccgggctgagacccaggcagggaggggtgacgttcccagggagacggtggccgggctgccctggccccagtgctccaagcacttgtcgacgtctcctagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtctcctagcaattcgctgagcgggctggcaaggc

SEQ ID NO: 2789 - DNA, 495 bp, Artificial Sequence
  source: /note="Description of Artificial Sequence: Synthetic polynucleotide"
gcctccctcgcgccatcaggtctcctatgagcgaaccagccacacagacccccgggctgagacccaggcagggaggggtgacgttcccagggagacggtggccgggctgccctggccccagtgctccaagcacttgtcgacgtctcctatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtctcctatgagcgaactgagcgggctggcaaggc

SEQ ID NO: 2790 - DNA, 495 bp, Artificial Sequence
  source: /note="Description of Artificial Sequence: Synthetic polynucleotide"
gcctccctcgcgccatcaggtctcctatactaagcccagccacacagacccccgggctgagacccaggcagggaggggtgacgttcccagggagacggtggccgggctgccctggccccagtgctccaagcacttgtcgacgtctcctatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtctcctatactaagcctgagcgggctggcaaggc

SEQ ID NO: 2791 - DNA, 495 bp, Artificial Sequence
  source: /note="Description of Artificial Sequence: Synthetic polynucleotide"
gcctccctcgcgccatcaggtctcctatggcgtatccagccacacagacccccgggctgagacccaggcagggaggggtgacgttcccagggagacggtggccgggctgccctggccccagtgctccaagcacttgtcgacgtctcctatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtctcctatggcgtatctgagcgggctggcaaggc

SEQ ID NO: 2792 - DNA, 495 bp, Artificial Sequence
  source: /note="Description of Artificial Sequence: Synthetic polynucleotide"
gcctccctcgcgccatcaggtctcctagataaccaccagccacacagacccccgggctgagacccaggcagggaggggtgacgttcccagggagacggtggccgggctgccctggccccagtgctccaagcacttgtcgacgtctcctagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtctcctagataaccactgagcgggctggcaaggc

SEQ ID NO: 2793 - DNA, 495 bp, Artificial Sequence
  source: /note="Description of Artificial Sequence: Synthetic polynucleotide"
gcctccctcgcgccatcaggtctcctactagtgaaccagccacacagacccccgggctgagacccaggcagggaggggtgacgttcccagggagacggtggccgggctgccctggccccagtgctccaagcacttgtcgacgtctcctactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtctcctactagtgaactgagcgggctggcaaggc

SEQ ID NO: 2794 - DNA, 495 bp, Artificial Sequence
  source: /note="Description of Artificial Sequence: Synthetic polynucleotide"
gcctccctcgcgccatcaggtctcctaacgttcacccagccacacagacccccgggctgagacccaggcagggaggggtgacgttcccagggagacggtggccgggctgccctggccccagtgctccaagcacttgtcgacgtctcctaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtctcctaacgttcacctgagcgggctggcaaggc

SEQ ID NO: 2795 - DNA, 448 bp, Artificial Sequence
  source: /note="Description of Artificial Sequence: Synthetic polynucleotide"
gcctccctcgcgccatcaggtctcctaattacgctccagccacacagacccccgggctgagacccaggcagggaggggtgacgttcccagggagacggtggccgggctgccctggccccagtgctccaagcacttgtcgacgtctcctaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtctcctaattacgctctgagcgggctggcaaggc

SEQ ID NO: 2796 - DNA, 495 bp, Artificial Sequence
  source: /note="Description of Artificial Sequence: Synthetic polynucleotide"
gcctccctcgcgccatcaggtctcctacattgagtccagccacacagacccccgggctgagacccaggcagggaggggtgacgttcccagggagacggtggccgggctgccctggccccagtgctccaagcacttgtcgacgtctcctacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtctcctacattgagtctgagcgggctggcaaggc

SEQ ID NO: 2797 - DNA, 495 bp, Artificial Sequence
  source: /note="Description of Artificial Sequence: Synthetic polynucleotide"
gcctccctcgcgccatcaggtagacaccttggttacctgcccttctcatggaaccctctgctggcctcccacgtaccccacattctggcctgacccctcagaagccagaccactgtcggcctgggaagtccaactgtcgacgtagacaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtagacaccttggttactgagcgggctggcaaggc

SEQ ID NO: 2798 - DNA, 495 bp, Artificial Sequence
  source: /note="Description of Artificial Sequence: Synthetic polynucleotide"
gcctccctcgcgccatcaggtagacacacctcttgcctgcccttctcatggaaccctctgctggcctcccacgtaccccacattctggcctgacccctcagaagccagaccactgtcggcctgggaagtccaactgtcgacgtagacacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtagacacacctcttgctgagcgggctggcaaggc

SEQ ID NO: 2799 - DNA, 495 bp, Artificial Sequence
  source: /note="Description of Artificial Sequence: Synthetic polynucleotide"
gcctccctcgcgccatcaggtagacacctgattctcctgcccttctcatggaaccctctgctggcctcccacgtaccccacattctggcctgacccctcagaagccagaccactgtcggcctgggaagtccaactgtcgacgtagacacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtagacacctgattctctgagcgggctggcaaggc

SEQ ID NO: 2800 - DNA, 495 bp, Artificial Sequence
  source: /note="Description of Artificial Sequence: Synthetic polynucleotide"
gcctccctcgcgccatcaggtagacacagtaccgacctgcccttctcatggaaccctctgctggcctcccacgtaccccacattctggcctgacccctcagaagccagaccactgtcggcctgggaagtccaactgtcgacgtagacacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtagacacagtaccgactgagcgggctggcaaggc

SEQ ID NO: 2801 - DNA, 495 bp, Artificial Sequence
  source: /note="Description of Artificial Sequence: Synthetic polynucleotide"
gcctccctcgcgccatcaggtagacacatccatggcctgcccttctcatggaaccctctgctggcctcccacgtaccccacattctggcctgacccctcagaagccagaccactgtcggcctgggaagtccaactgtcgacgtagacacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtagacacatccatggctgagcgggctggcaaggc

SEQ ID NO: 2802 - DNA, 495 bp, Artificial Sequence
  source: /note="Description of Artificial Sequence: Synthetic polynucleotide"
gcctccctcgcgccatcaggtagacacgtagcagtcctgcccttctcatggaaccctctgctggcctcccacgtaccccacattctggcctgacccctcagaagccagaccactgtcggcctgggaagtccaactgtcgacgtagacacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtagacacgtagcagtctgagcgggctggcaaggc

SEQ ID NO: 2803 - DNA, 495 bp, Artificial Sequence
  source: /note="Description of Artificial Sequence: Synthetic polynucleotide"
gcctccctcgcgccatcaggtagacacatcttcgtcctgcccttctcatggaaccctctgctggcctcccacgtaccccacattctggcctgacccctcagaagccagaccactgtcggcctgggaagtccaactgtcgacgtagacacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtagacacatcttcgtctgagcgggctggcaaggc

SEQ ID NO: 2804 - DNA, 495 bp, Artificial Sequence
  source: /note="Description of Artificial Sequence: Synthetic polynucleotide"
gcctccctcgcgccatcaggtagacactccacagtcctgcccttctcatggaaccctctgctggcctcccacgtaccccacattctggcctgacccctcagaagccagaccactgtcggcctgggaagtccaactgtcgacgtagacactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtagacactccacagtctgagcgggctggcaaggc

SEQ ID NO: 2805 - DNA, 495 bp, Artificial Sequence
  source: /note="Description of Artificial Sequence: Synthetic polynucleotide"
gcctccctcgcgccatcaggtagacacagctagtgcctgcccttctcatggaaccctctgctggcctcccacgtaccccacattctggcctgacccctcagaagccagaccactgtcggcctgggaagtccaactgtcgacgtagacacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtagacacagctagtgctgagcgggctggcaaggc

SEQ ID NO: 2806 - DNA, 495 bp, Artificial Sequence
  source: /note="Description of Artificial Sequence: Synthetic polynucleotide"
gcctccctcgcgccatcaggtagacactaaccaagcctgcccttctcatggaaccctctgctggcctcccacgtaccccacattctggcctgacccctcagaagccagaccactgtcggcctgggaagtccaactgtcgacgtagacactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtagacactaaccaagctgagcgggctggcaaggc

SEQ ID NO: 2807 - DNA, 495 bp, Artificial Sequence
  source: /note="Description of Artificial Sequence: Synthetic polynucleotide"
gcctccctcgcgccatcaggtagacaccaagaggtcctgcccttctcatggaaccctctgctggcctcccacgtaccccacattctggcctgacccctcagaagccagaccactgtcggcctgggaagtccaactgtcgacgtagacaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtagacaccaagaggtctgagcgggctggcaaggc

SEQ ID NO: 2808 - DNA, 495 bp, Artificial Sequence
  source: /note="Description of Artificial Sequence: Synthetic polynucleotide"
gcctccctcgcgccatcaggtagacacagttgacccctgcccttctcatggaaccctctgctggcctcccacgtaccccacattctggcctgacccctcagaagccagaccactgtcggcctgggaagtccaactgtcgacgtagacacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtagacacagttgaccctgagcgggctggcaaggc

SEQ ID NO: 2809 - DNA, 495 bp, Artificial Sequence
  source: /note="Description of Artificial Sequence: Synthetic polynucleotide"
gcctccctcgcgccatcaggtagacaccagcatatcctgcccttctcatggaaccctctgctggcctcccacgtaccccacattctggcctgacccctcagaagccagaccactgtcggcctgggaagtccaactgtcgacgtagacaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtagacaccagcatatctgagcgggctggcaaggc

SEQ ID NO: 2810 - DNA, 495 bp, Artificial Sequence
  source: /note="Description of Artificial Sequence: Synthetic polynucleotide"
gcctccctcgcgccatcaggtagacacgcaggattcctgcccttctcatggaaccctctgctggcctcccacgtaccccacattctggcctgacccctcagaagccagaccactgtcggcctgggaagtccaactgtcgacgtagacacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtagacacgcaggattctgagcgggctggcaaggc

SEQ ID NO: 2811 - DNA, 495 bp, Artificial Sequence
  source: /note="Description of Artificial Sequence: Synthetic polynucleotide"
gcctccctcgcgccatcaggtagacacgtccattccctgcccttctcatggaaccctctgctggcctcccacgtaccccacattctggcctgacccctcagaagccagaccactgtcggcctgggaagtccaactgtcgacgtagacacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtagacacgtccattcctgagcgggctggcaaggc

SEQ ID NO: 2812 - DNA, 495 bp, Artificial Sequence
  source: /note="Description of Artificial Sequence: Synthetic polynucleotide"
gcctccctcgcgccatcaggtagacacgcataactcctgcccttctcatggaaccctctgctggcctcccacgtaccccacattctggcctgacccctcagaagccagaccactgtcggcctgggaagtccaactgtcgacgtagacacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtagacacgcataactctgagcgggctggcaaggc

SEQ ID NO: 2813 - DNA, 495 bp, Artificial Sequence
  source: /note="Description of Artificial Sequence: Synthetic polynucleotide"
gcctccctcgcgccatcaggtagacacatatgctgcctgcccttctcatggaaccctctgctggcctcccacgtaccccacattctggcctgacccctcagaagccagaccactgtcggcctgggaagtccaactgtcgacgtagacacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtagacacatatgctgctgagcgggctggcaaggc

SEQ ID NO: 2814 - DNA, 495 bp, Artificial Sequence
  source: /note="Description of Artificial Sequence: Synthetic polynucleotide"
gcctccctcgcgccatcaggtagacacaatcctgccctgcccttctcatggaaccctctgctggcctcccacgtaccccacattctggcctgacccctcagaagccagaccactgtcggcctgggaagtccaactgtcgacgtagacacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtagacacaatcctgcctgagcgggctggcaaggc

SEQ ID NO: 2815 - DNA, 495 bp, Artificial Sequence
  source: /note="Description of Artificial Sequence: Synthetic polynucleotide"
gcctccctcgcgccatcaggtagacactgagacctcctgcccttctcatggaaccctctgctggcctcccacgtaccccacattctggcctgacccctcagaagccagaccactgtcggcctgggaagtccaactgtcgacgtagacactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtagacactgagacctctgagcgggctggcaaggc

SEQ ID NO: 2816 - DNA, 495 bp, Artificial Sequence
  source: /note="Description of Artificial Sequence: Synthetic polynucleotide"
gcctccctcgcgccatcaggtagacacgaatggaccctgcccttctcatggaaccctctgctggcctcccacgtaccccacattctggcctgacccctcagaagccagaccactgtcggcctgggaagtccaactgtcgacgtagacacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtagacacgaatggacctgagcgggctggcaaggc

SEQ ID NO: 2817 - DNA, 495 bp, Artificial Sequence
  source: /note="Description of Artificial Sequence: Synthetic polynucleotide"
gcctccctcgcgccatcaggtagacaccacatggacctgcccttctcatggaaccctctgctggcctcccacgtaccccacattctggcctgacccctcagaagccagaccactgtcggcctgggaagtccaactgtcgacgtagacaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtagacaccacatggactgagcgggctggcaaggc

SEQ ID NO: 2818 - DNA, 495 bp, Artificial Sequence
  source: /note="Description of Artificial Sequence: Synthetic polynucleotide"
gcctccctcgcgccatcaggtagacacttgaccatcctgcccttctcatggaaccctctgctggcctcccacgtaccccacattctggcctgacccctcagaagccagaccactgtcggcctgggaagtccaactgtcgacgtagacacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtagacacttgaccatctgagcgggctggcaaggc

SEQ ID NO: 2819 - DNA, 495 bp, Artificial Sequence
  source: /note="Description of Artificial Sequence: Synthetic polynucleotide"
gcctccctcgcgccatcaggtagacacaagccatccctgcccttctcatggaaccctctgctggcctcccacgtaccccacattctggcctgacccctcagaagccagaccactgtcggcctgggaagtccaactgtcgacgtagacacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtagacacaagccatcctgagcgggctggcaaggc

SEQ ID NO: 2820 - DNA, 495 bp, Artificial Sequence
  source: /note="Description of Artificial Sequence: Synthetic polynucleotide"
gcctccctcgcgccatcaggtagacactccatgtgcctgcccttctcatggaaccctctgctggcctcccacgtaccccacattctggcctgacccctcagaagccagaccactgtcggcctgggaagtccaactgtcgacgtagacactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacactccatgtgctgagcgggctggcaaggc

SEQ ID NO: 2821 - DNA, 495 bp, Artificial Sequence
  source: /note="Description of Artificial Sequence: Synthetic polynucleotide"
gcctccctcgcgccatcaggtagacaccaagtcaccctgcccttctcatggaaccctctgctggcctcccacgtaccccacattctggcctgacccctcagaagccagaccactgtcggcctgggaagtccaactgtcgacgtagacaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacaccaagtcacctgagcgggctggcaaggc

SEQ ID NO: 2822 - DNA, 495 bp, Artificial Sequence
  source: /note="Description of Artificial Sequence: Synthetic polynucleotide"
gcctccctcgcgccatcaggtagacacctgcaatccctgcccttctcatggaaccctctgctggcctcccacgtaccccacattctggcctgacccctcagaagccagaccactgtcggcctgggaagtccaactgtcgacgtagacacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtagacacctgcaatcctgagcgggctggcaaggc

SEQ ID NO: 2823 - DNA, 495 bp, Artificial Sequence
  source: /note="Description of Artificial Sequence: Synthetic polynucleotide"
gcctccctcgcgccatcaggtagacacatcgacgacctgcccttctcatggaaccctctgctggcctcccacgtaccccacattctggcctgacccctcagaagccagaccactgtcggcctgggaagtccaactgtcgacgtagacacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtagacacatcgacgactgagcgggctggcaaggc

SEQ ID NO: 2824 - DNA, 495 bp, Artificial Sequence
  source: /note="Description of Artificial Sequence: Synthetic polynucleotide"
gcctccctcgcgccatcaggtagacacacagactgcctgcccttctcatggaaccctctgctggcctcccacgtaccccacattctggcctgacccctcagaagccagaccactgtcggcctgggaagtccaactgtcgacgtagacacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtagacacacagactgctgagcgggctggcaaggc

SEQ ID NO: 2825 - DNA, 495 bp, Artificial Sequence
  source: /note="Description of Artificial Sequence: Synthetic polynucleotide"
gcctccctcgcgccatcaggtagacacccttatagcctgcccttctcatggaaccctctgctggcctcccacgtaccccacattctggcctgacccctcagaagccagaccactgtcggcctgggaagtccaactgtcgacgtagacacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtagacacccttatagctgagcgggctggcaaggc

SEQ ID NO: 2826 - DNA, 495 bp, Artificial Sequence
  source: /note="Description of Artificial Sequence: Synthetic polynucleotide"
gcctccctcgcgccatcaggtagacactacgcgttcctgcccttctcatggaaccctctgctggcctcccacgtaccccacattctggcctgacccctcagaagccagaccactgtcggcctgggaagtccaactgtcgacgtagacactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtagacactacgcgttctgagcgggctggcaaggc

SEQ ID NO: 2827 - DNA, 495 bp, Artificial Sequence
  source: /note="Description of Artificial Sequence: Synthetic polynucleotide"
gcctccctcgcgccatcaggtagacacctataaggcctgcccttctcatggaaccctctgctggcctcccacgtaccccacattctggcctgacccctcagaagccagaccactgtcggcctgggaagtccaactgtcgacgtagacacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtagacacctataaggctgagcgggctggcaaggc

SEQ ID NO: 2828 - DNA, 495 bp, Artificial Sequence
  source: /note="Description of Artificial Sequence: Synthetic polynucleotide"
gcctccctcgcgccatcaggtagacactcttagtccctgcccttctcatggaaccctctgctggcctcccacgtaccccacattctggcctgacccctcagaagccagaccactgtcggcctgggaagtccaactgtcgacgtagacactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacactcttagtcctgagcgggctggcaaggc

SEQ ID NO: 2829 - DNA, 495 bp, Artificial Sequence
  source: /note="Description of Artificial Sequence: Synthetic polynucleotide"
gcctccctcgcgccatcaggtagacactgtctgcacctgcccttctcatggaaccctctgctggcctcccacgtaccccacattctggcctgacccctcagaagccagaccactgtcggcctgggaagtccaactgtcgacgtagacactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtagacactgtctgcactgagcgggctggcaaggc

SEQ ID NO: 2830 - DNA, 495 bp, Artificial Sequence
  source: /note="Description of Artificial Sequence: Synthetic polynucleotide"
gcctccctcgcgccatcaggtagacacgccattaacctgcccttctcatggaaccctctgctggcctcccacgtaccccacattctggcctgacccctcagaagccagaccactgtcggcctgggaagtccaactgtcgacgtagacacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacacgccattaactgagcgggctggcaaggc

SEQ ID NO: 2831 - DNA, 495 bp, Artificial Sequence
  source: /note="Description of Artificial Sequence: Synthetic polynucleotide"
gcctccctcgcgccatcaggtagacacgactaagacctgcccttctcatggaaccctctgctggcctcccacgtaccccacattctggcctgacccctcagaagccagaccactgtcggcctgggaagtccaactgtcgacgtagacacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtagacacgactaagactgagcgggctggcaaggc

SEQ ID NO: 2832 - DNA, 495 bp, Artificial Sequence
  source: /note="Description of Artificial Sequence: Synthetic polynucleotide"
gcctccctcgcgccatcaggtagacacaggttgctcctgcccttctcatggaaccctctgctggcctcccacgtaccccacattctggcctgacccctcagaagccagaccactgtcggcctgggaagtccaactgtcgacgtagacacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtagacacaggttgctctgagcgggctggcaaggc

SEQ ID NO: 2833 - DNA, 495 bp, Artificial Sequence
  source: /note="Description of Artificial Sequence: Synthetic polynucleotide"
gcctccctcgcgccatcaggtagacacctcgagaacctgcccttctcatggaaccctctgctggcctcccacgtaccccacattctggcctgacccctcagaagccagaccactgtcggcctgggaagtccaactgtcgacgtagacacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtagacacctcgagaactgagcgggctggcaaggc

SEQ ID NO: 2834 - DNA, 495 bp, Artificial Sequence
  source: /note="Description of Artificial Sequence: Synthetic polynucleotide"
gcctccctcgcgccatcaggtagacacttaatggccctgcccttctcatggaaccctctgctggcctcccacgtaccccacattctggcctgacccctcagaagccagaccactgtcggcctgggaagtccaactgtcgacgtagacacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtagacacttaatggcctgagcgggctggcaaggc

SEQ ID NO: 2835 - DNA, 495 bp, Artificial Sequence
  source: /note="Description of Artificial Sequence: Synthetic polynucleotide"
gcctccctcgcgccatcaggtagacactgcagacacctgcccttctcatggaaccctctgctggcctcccacgtaccccacattctggcctgacccctcagaagccagaccactgtcggcctgggaagtccaactgtcgacgtagacactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtagacactgcagacactgagcgggctggcaaggc

SEQ ID NO: 2836 - DNA, 495 bp, Artificial Sequence
  source: /note="Description of Artificial Sequence: Synthetic polynucleotide"
gcctccctcgcgccatcaggtagacactcactgagcctgcccttctcatggaaccctctgctggcctcccacgtaccccacattctggcctgacccctcagaagccagaccactgtcggcctgggaagtccaactgtcgacgtagacactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtagacactcactgagctgagcgggctggcaaggc

SEQ ID NO: 2837 - DNA, 495 bp, Artificial Sequence
  source: /note="Description of Artificial Sequence: Synthetic polynucleotide"
gcctccctcgcgccatcaggtagacacgagtacgtcctgcccttctcatggaaccctctgctggcctcccacgtaccccacattctggcctgacccctcagaagccagaccactgtcggcctgggaagtccaactgtcgacgtagacacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtagacacgagtacgtctgagcgggctggcaaggc

SEQ ID NO: 2838 - DNA, 495 bp, Artificial Sequence
  source: /note="Description of Artificial Sequence: Synthetic polynucleotide"
gcctccctcgcgccatcaggtagacacatacgccacctgcccttctcatggaaccctctgctggcctcccacgtaccccacattctggcctgacccctcagaagccagaccactgtcggcctgggaagtccaactgtcgacgtagacacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtagacacatacgccactgagcgggctggcaaggc

SEQ ID NO: 2839 - DNA, 495 bp, Artificial Sequence
  source: /note="Description of Artificial Sequence: Synthetic polynucleotide"
gcctccctcgcgccatcaggtagacactcgcatcacctgcccttctcatggaaccctctgctggcctcccacgtaccccacattctggcctgacccctcagaagccagaccactgtcggcctgggaagtccaactgtcgacgtagacactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtagacactcgcatcactgagcgggctggcaaggc

SEQ ID NO: 2840 - DNA, 495 bp, Artificial Sequence
  source: /note="Description of Artificial Sequence: Synthetic polynucleotide"
gcctccctcgcgccatcaggtagacaccgcttaatcctgcccttctcatggaaccctctgctggcctcccacgtaccccacattctggcctgacccctcagaagccagaccactgtcggcctgggaagtccaactgtcgacgtagacaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtagacaccgcttaatctgagcgggctggcaaggc

SEQ ID NO: 2841 - DNA, 495 bp, Artificial Sequence
  source: /note="Description of Artificial Sequence: Synthetic polynucleotide"
gcctccctcgcgccatcaggtagacactggttatccctgcccttctcatggaaccctctgctggcctcccacgtaccccacattctggcctgacccctcagaagccagaccactgtcggcctgggaagtccaactgtcgacgtagacactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtagacactggttatcctgagcgggctggcaaggc

SEQ ID NO: 2842 - DNA, 495 bp, Artificial Sequence
  source: /note="Description of Artificial Sequence: Synthetic polynucleotide"
gcctccctcgcgccatcaggtagacacggattgctcctgcccttctcatggaaccctctgctggcctcccacgtaccccacattctggcctgacccctcagaagccagaccactgtcggcctgggaagtccaactgtcgacgtagacacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtagacacggattgctctgagcgggctggcaaggc

SEQ ID NO: 2843 - DNA, 495 bp, Artificial Sequence
  source: /note="Description of Artificial Sequence: Synthetic polynucleotide"
gcctccctcgcgccatcaggtagacacctcagtgacctgcccttctcatggaaccctctgctggcctcccacgtaccccacattctggcctgacccctcagaagccagaccactgtcggcctgggaagtccaactgtcgacgtagacacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtagacacctcagtgactgagcgggctggcaaggc

SEQ ID NO: 2844 - DNA, 495 bp, Artificial Sequence
  source: /note="Description of Artificial Sequence: Synthetic polynucleotide"
gcctccctcgcgccatcaggtagacacacgtactccctgcccttctcatggaaccctctgctggcctcccacgtaccccacattctggcctgacccctcagaagccagaccactgtcggcctgggaagtccaactgtcgacgtagacacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtagacacacgtactcctgagcgggctggcaaggc

SEQ ID NO: 2845 - DNA, 495 bp, Artificial Sequence
  source: /note="Description of Artificial Sequence: Synthetic polynucleotide"
gcctccctcgcgccatcaggtagacactgatgcgacctgcccttctcatggaaccctctgctggcctcccacgtaccccacattctggcctgacccctcagaagccagaccactgtcggcctgggaagtccaactgtcgacgtagacactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtagacactgatgcgactgagcgggctggcaaggc

SEQ ID NO: 2846 - DNA, 495 bp, Artificial Sequence
  source: /note="Description of Artificial Sequence: Synthetic polynucleotide"
gcctccctcgcgccatcaggtagacacattaagcgcctgcccttctcatggaaccctctgctggcctcccacgtaccccacattctggcctgacccctcagaagccagaccactgtcggcctgggaagtccaactgtcgacgtagacacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtagacacattaagcgctgagcgggctggcaaggc

SEQ ID NO: 2847 - DNA, 495 bp, Artificial Sequence
  source: /note="Description of Artificial Sequence: Synthetic polynucleotide"
gcctccctcgcgccatcaggtagacacagcaatcccctgcccttctcatggaaccctctgctggcctcccacgtaccccacattctggcctgacccctcagaagccagaccactgtcggcctgggaagtccaactgtcgacgtagacacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtagacacagcaatccctgagcgggctggcaaggc

SEQ ID NO: 2848 - DNA, 495 bp, Artificial Sequence
  source: /note="Description of Artificial Sequence: Synthetic polynucleotide"
gcctccctcgcgccatcaggtagacacgcttagtacctgcccttctcatggaaccctctgctggcctcccacgtaccccacattctggcctgacccctcagaagccagaccactgtcggcctgggaagtccaactgtcgacgtagacacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtagacacgcttagtactgagcgggctggcaaggc

SEQ ID NO: 2849 - DNA, 495 bp, Artificial Sequence
  source: /note="Description of Artificial Sequence: Synthetic polynucleotide"
gcctccctcgcgccatcaggtagacactgaccttgcctgcccttctcatggaaccctctgctggcctcccacgtaccccacattctggcctgacccctcagaagccagaccactgtcggcctgggaagtccaactgtcgacgtagacactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtagacactgaccttgctgagcgggctggcaaggc

SEQ ID NO: 2850 - DNA, 495 bp, Artificial Sequence
  source: /note="Description of Artificial Sequence: Synthetic polynucleotide"
gcctccctcgcgccatcaggtagacaccaaggtcacctgcccttctcatggaaccctctgctggcctcccacgtaccccacattctggcctgacccctcagaagccagaccactgtcggcctgggaagtccaactgtcgacgtagacaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtagacaccaaggtcactgagcgggctggcaaggc

SEQ ID NO: 2851 - DNA, 495 bp, Artificial Sequence
  source: /note="Description of Artificial Sequence: Synthetic polynucleotide"
gcctccctcgcgccatcaggtagacaccactgtaccctgcccttctcatggaaccctctgctggcctcccacgtaccccacattctggcctgacccctcagaagccagaccactgtcggcctgggaagtccaactgtcgacgtagacaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtagacaccactgtacctgagcgggctggcaaggc

SEQ ID NO: 2852 - DNA, 495 bp, Artificial Sequence
  source: /note="Description of Artificial Sequence: Synthetic polynucleotide"
gcctccctcgcgccatcaggtagacacgatgatcccctgcccttctcatggaaccctctgctggcctcccacgtaccccacattctggcctgacccctcagaagccagaccactgtcggcctgggaagtccaactgtcgacgtagacacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtagacacgatgatccctgagcgggctggcaaggc

SEQ ID NO: 2853 - DNA, 495 bp, Artificial Sequence
  source: /note="Description of Artificial Sequence: Synthetic polynucleotide"
gcctccctcgcgccatcaggtagacaccgccaatacctgcccttctcatggaaccctctgctggcctcccacgtaccccacattctggcctgacccctcagaagccagaccactgtcggcctgggaagtccaactgtcgacgtagacaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtagacaccgccaatactgagcgggctggcaaggc

SEQ ID NO: 2854 - DNA, 495 bp, Artificial Sequence
  source: /note="Description of Artificial Sequence: Synthetic polynucleotide"
gcctccctcgcgccatcaggtagacactcaagcctcctgcccttctcatggaaccctctgctggcctcccacgtaccccacattctggcctgacccctcagaagccagaccactgtcggcctgggaagtccaactgtcgacgtagacactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtagacactcaagcctctgagcgggctggcaaggc

SEQ ID NO: 2855 - DNA, 495 bp, Artificial Sequence
  source: /note="Description of Artificial Sequence: Synthetic polynucleotide"
gcctccctcgcgccatcaggtagacacacgtgtgtcctgcccttctcatggaaccctctgctggcctcccacgtaccccacattctggcctgacccctcagaagccagaccactgtcggcctgggaagtccaactgtcgacgtagacacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtagacacacgtgtgtctgagcgggctggcaaggc

SEQ ID NO: 2856 - DNA, 495 bp, Artificial Sequence
  source: /note="Description of Artificial Sequence: Synthetic polynucleotide"
gcctccctcgcgccatcaggtagacactccgtctacctgcccttctcatggaaccctctgctggcctcccacgtaccccacattctggcctgacccctcagaagccagaccactgtcggcctgggaagtccaactgtcgacgtagacactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtagacactccgtctactgagcgggctggcaaggc

SEQ ID NO: 2857 - DNA, 495 bp, Artificial Sequence
  source: /note="Description of Artificial Sequence: Synthetic polynucleotide"
gcctccctcgcgccatcaggtagacacaagagctgcctgcccttctcatggaaccctctgctggcctcccacgtaccccacattctggcctgacccctcagaagccagaccactgtcggcctgggaagtccaactgtcgacgtagacacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtagacacaagagctgctgagcgggctggcaaggc

SEQ ID NO: 2858 - DNA, 495 bp, Artificial Sequence
  source: /note="Description of Artificial Sequence: Synthetic polynucleotide"
gcctccctcgcgccatcaggtagacactatcgctccctgcccttctcatggaaccctctgctggcctcccacgtaccccacattctggcctgacccctcagaagccagaccactgtcggcctgggaagtccaactgtcgacgtagacactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtagacactatcgctcctgagcgggctggcaaggc

SEQ ID NO: 2859 - DNA, 495 bp, Artificial Sequence
  source: /note="Description of Artificial Sequence: Synthetic polynucleotide"
gcctccctcgcgccatcaggtagacactcagatgccctgcccttctcatggaaccctctgctggcctcccacgtaccccacattctggcctgacccctcagaagccagaccactgtcggcctgggaagtccaactgtcgacgtagacactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtagacactcagatgcctgagcgggctggcaaggc

SEQ ID NO: 2860 - DNA, 495 bp, Artificial Sequence
  source: /note="Description of Artificial Sequence: Synthetic polynucleotide"
gcctccctcgcgccatcaggtagacacgtgtagcacctgcccttctcatggaaccctctgctggcctcccacgtaccccacattctggcctgacccctcagaagccagaccactgtcggcctgggaagtccaactgtcgacgtagacacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtagacacgtgtagcactgagcgggctggcaaggc

SEQ ID NO: 2861 - DNA, 495 bp, Artificial Sequence
  source: /note="Description of Artificial Sequence: Synthetic polynucleotide"
gcctccctcgcgccatcaggtagacactggcagttcctgcccttctcatggaaccctctgctggcctcccacgtaccccacattctggcctgacccctcagaagccagaccactgtcggcctgggaagtccaactgtcgacgtagacactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtagacactggcagttctgagcgggctggcaaggc

SEQ ID NO: 2862 - DNA, 495 bp, Artificial Sequence
  source: /note="Description of Artificial Sequence: Synthetic polynucleotide"
gcctccctcgcgccatcaggtagacaccagtccaacctgcccttctcatggaaccctctgctggcctcccacgtaccccacattctggcctgacccctcagaagccagaccactgtcggcctgggaagtccaactgtcgacgtagacaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtagacaccagtccaactgagcgggctggcaaggc

SEQ ID NO: 2863 - DNA, 495 bp, Artificial Sequence
  source: /note="Description of Artificial Sequence: Synthetic polynucleotide"
gcctccctcgcgccatcaggtagacacgtgtctaccctgcccttctcatggaaccctctgctggcctcccacgtaccccacattctggcctgacccctcagaagccagaccactgtcggcctgggaagtccaactgtcgacgtagacacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtagacacgtgtctacctgagcgggctggcaaggc

SEQ ID NO: 2864 - DNA, 495 bp, Artificial Sequence
  source: /note="Description of Artificial Sequence: Synthetic polynucleotide"
gcctccctcgcgccatcaggtagacacgtacagtgcctgcccttctcatggaaccctctgctggcctcccacgtaccccacattctggcctgacccctcagaagccagaccactgtcggcctgggaagtccaactgtcgacgtagacacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtagacacgtacagtgctgagcgggctggcaaggc

SEQ ID NO: 2865 - DNA, 495 bp, Artificial Sequence
  source: /note="Description of Artificial Sequence: Synthetic polynucleotide"
gcctccctcgcgccatcaggtagacacggatcatccctgcccttctcatggaaccctctgctggcctcccacgtaccccacattctggcctgacccctcagaagccagaccactgtcggcctgggaagtccaactgtcgacgtagacacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtagacacggatcatcctgagcgggctggcaaggc

SEQ ID NO: 2866 - DNA, 495 bp, Artificial Sequence
  source: /note="Description of Artificial Sequence: Synthetic polynucleotide"
gcctccctcgcgccatcaggtagacactattggcgcctgcccttctcatggaaccctctgctggcctcccacgtaccccacattctggcctgacccctcagaagccagaccactgtcggcctgggaagtccaactgtcgacgtagacactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtagacactattggcgctgagcgggctggcaaggc

SEQ ID NO: 2867 - DNA, 495 bp, Artificial Sequence
  source: /note="Description of Artificial Sequence: Synthetic polynucleotide"
gcctccctcgcgccatcaggtagacacaggcttgacctgcccttctcatggaaccctctgctggcctcccacgtaccccacattctggcctgacccctcagaagccagaccactgtcggcctgggaagtccaactgtcgacgtagacacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtagacacaggcttgactgagcgggctggcaaggc

SEQ ID NO: 2868 - DNA, 495 bp, Artificial Sequence
  source: /note="Description of Artificial Sequence: Synthetic polynucleotide"
gcctccctcgcgccatcaggtagacacacacacgtcctgcccttctcatggaaccctctgctggcctcccacgtaccccacattctggcctgacccctcagaagccagaccactgtcggcctgggaagtccaactgtcgacgtagacacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtagacacacacacgtctgagcgggctggcaaggc

SEQ ID NO: 2869 - DNA, 495 bp, Artificial Sequence
  source: /note="Description of Artificial Sequence: Synthetic polynucleotide"
gcctccctcgcgccatcaggtagacactagacggacctgcccttctcatggaaccctctgctggcctcccacgtaccccacattctggcctgacccctcagaagccagaccactgtcggcctgggaagtccaactgtcgacgtagacactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtagacactagacggactgagcgggctggcaaggc

SEQ ID NO: 2870 - DNA, 495 bp, Artificial Sequence
  source: /note="Description of Artificial Sequence: Synthetic polynucleotide"
gcctccctcgcgccatcaggtagacacgagcgatacctgcccttctcatggaaccctctgctggcctcccacgtaccccacattctggcctgacccctcagaagccagaccactgtcggcctgggaagtccaactgtcgacgtagacacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtagacacgagcgatactgagcgggctggcaaggc

SEQ ID NO: 2871 - DNA, 495 bp, Artificial Sequence
  source: /note="Description of Artificial Sequence: Synthetic polynucleotide"
gcctccctcgcgccatcaggtagacacgcatctgacctgcccttctcatggaaccctctgctggcctcccacgtaccccacattctggcctgacccctcagaagccagaccactgtcggcctgggaagtccaactgtcgacgtagacacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtagacacgcatctgactgagcgggctggcaaggc

SEQ ID NO: 2872 - DNA, 495 bp, Artificial Sequence
  source: /note="Description of Artificial Sequence: Synthetic polynucleotide"
gcctccctcgcgccatcaggtagacactgctacaccctgcccttctcatggaaccctctgctggcctcccacgtaccccacattctggcctgacccctcagaagccagaccactgtcggcctgggaagtccaactgtcgacgtagacactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtagacactgctacacctgagcgggctggcaaggc

SEQ ID NO: 2873 - DNA, 495 bp, Artificial Sequence
  source: /note="Description of Artificial Sequence: Synthetic polynucleotide"
gcctccctcgcgccatcaggtagacacaactgccacctgcccttctcatggaaccctctgctggcctcccacgtaccccacattctggcctgacccctcagaagccagaccactgtcggcctgggaagtccaactgtcgacgtagacacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtagacacaactgccactgagcgggctggcaaggc

SEQ ID NO: 2874 - DNA, 495 bp, Artificial Sequence
  source: /note="Description of Artificial Sequence: Synthetic polynucleotide"
gcctccctcgcgccatcaggtagacacttggactgcctgcccttctcatggaaccctctgctggcctcccacgtaccccacattctggcctgacccctcagaagccagaccactgtcggcctgggaagtccaactgtcgacgtagacacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtagacacttggactgctgagcgggctggcaaggc

SEQ ID NO: 2875 - DNA, 495 bp, Artificial Sequence
  source: /note="Description of Artificial Sequence: Synthetic polynucleotide"
gcctccctcgcgccatcaggtagacactcggtactcctgcccttctcatggaaccctctgctggcctcccacgtaccccacattctggcctgacccctcagaagccagaccactgtcggcctgggaagtccaactgtcgacgtagacactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtagacactcggtactctgagcgggctggcaaggc

SEQ ID NO: 2876 - DNA, 495 bp, Artificial Sequence
  source: /note="Description of Artificial Sequence: Synthetic polynucleotide"
gcctccctcgcgccatcaggtagacacccatggatcctgcccttctcatggaaccctctgctggcctcccacgtaccccacattctggcctgacccctcagaagccagaccactgtcggcctgggaagtccaactgtcgacgtagacacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtagacacccatggatctgagcgggctggcaaggc

SEQ ID NO: 2877 - DNA, 495 bp, Artificial Sequence
  source: /note="Description of Artificial Sequence: Synthetic polynucleotide"
gcctccctcgcgccatcaggtagacacacgaagatcctgcccttctcatggaaccctctgctggcctcccacgtaccccacattctggcctgacccctcagaagccagaccactgtcggcctgggaagtccaactgtcgacgtagacacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtagacacacgaagatctgagcgggctggcaaggc

SEQ ID NO: 2878 - DNA, 495 bp, Artificial Sequence
  source: /note="Description of Artificial Sequence: Synthetic polynucleotide"
gcctccctcgcgccatcaggtagacacactgtggacctgcccttctcatggaaccctctgctggcctcccacgtaccccacattctggcctgacccctcagaagccagaccactgtcggcctgggaagtccaactgtcgacgtagacacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtagacacactgtggactgagcgggctggcaaggc

SEQ ID NO: 2879 - DNA, 495 bp, Artificial Sequence
  source: /note="Description of Artificial Sequence: Synthetic polynucleotide"
gcctccctcgcgccatcaggtagacacggtgtcatcctgcccttctcatggaaccctctgctggcctcccacgtaccccacattctggcctgacccctcagaagccagaccactgtcggcctgggaagtccaactgtcgacgtagacacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtagacacggtgtcatctgagcgggctggcaaggc

SEQ ID NO: 2880 - DNA, 495 bp, Artificial Sequence
  source: /note="Description of Artificial Sequence: Synthetic polynucleotide"
gcctccctcgcgccatcaggtagacactcgtgaagcctgcccttctcatggaaccctctgctggcctcccacgtaccccacattctggcctgacccctcagaagccagaccactgtcggcctgggaagtccaactgtcgacgtagacactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtagacactcgtgaagctgagcgggctggcaaggc

SEQ ID NO: 2881 - DNA, 495 bp, Artificial Sequence
  source: /note="Description of Artificial Sequence: Synthetic polynucleotide"
gcctccctcgcgccatcaggtagacaccactagctcctgcccttctcatggaaccctctgctggcctcccacgtaccccacattctggcctgacccctcagaagccagaccactgtcggcctgggaagtccaactgtcgacgtagacaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtagacaccactagctctgagcgggctggcaaggc

SEQ ID NO: 2882 - DNA, 495 bp, Artificial Sequence
  source: /note="Description of Artificial Sequence: Synthetic polynucleotide"
gcctccctcgcgccatcaggtagacacggtcaactcctgcccttctcatggaaccctctgctggcctcccacgtaccccacattctggcctgacccctcagaagccagaccactgtcggcctgggaagtccaactgtcgacgtagacacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtagacacggtcaactctgagcgggctggcaaggc

SEQ ID NO: 2883 - DNA, 495 bp, Artificial Sequence
  source: /note="Description of Artificial Sequence: Synthetic polynucleotide"
gcctccctcgcgccatcaggtagacactacgtacgcctgcccttctcatggaaccctctgctggcctcccacgtaccccacattctggcctgacccctcagaagccagaccactgtcggcctgggaagtccaactgtcgacgtagacactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtagacactacgtacgctgagcgggctggcaaggc

SEQ ID NO: 2884 - DNA, 495 bp, Artificial Sequence
  source: /note="Description of Artificial Sequence: Synthetic polynucleotide"
gcctccctcgcgccatcaggtagacacatgacacccctgcccttctcatggaaccctctgctggcctcccacgtaccccacattctggcctgacccctcagaagccagaccactgtcggcctgggaagtccaactgtcgacgtagacacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtagacacatgacaccctgagcgggctggcaaggc

SEQ ID NO: 2885 - DNA, 495 bp, Artificial Sequence
  source: /note="Description of Artificial Sequence: Synthetic polynucleotide"
gcctccctcgcgccatcaggtagacaccttcacgacctgcccttctcatggaaccctctgctggcctcccacgtaccccacattctggcctgacccctcagaagccagaccactgtcggcctgggaagtccaactgtcgacgtagacaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtagacaccttcacgactgagcgggctggcaaggc

SEQ ID NO: 2886 - DNA, 495 bp, Artificial Sequence
  source: /note="Description of Artificial Sequence: Synthetic polynucleotide"
gcctccctcgcgccatcaggtagacacagaatcagcctgcccttctcatggaaccctctgctggcctcccacgtaccccacattctggcctgacccctcagaagccagaccactgtcggcctgggaagtccaactgtcgacgtagacacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtagacacagaatcagctgagcgggctggcaaggc

SEQ ID NO: 2887 - DNA, 495 bp, Artificial Sequence
  source: /note="Description of Artificial Sequence: Synthetic polynucleotide"
gcctccctcgcgccatcaggtagacacagttatgccctgcccttctcatggaaccctctgctggcctcccacgtaccccacattctggcctgacccctcagaagccagaccactgtcggcctgggaagtccaactgtcgacgtagacacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtagacacagttatgcctgagcgggctggcaaggc

SEQ ID NO: 2888 - DNA, 495 bp, Artificial Sequence
  source: /note="Description of Artificial Sequence: Synthetic polynucleotide"
gcctccctcgcgccatcaggtagacacaggtctcacctgcccttctcatggaaccctctgctggcctcccacgtaccccacattctggcctgacccctcagaagccagaccactgtcggcctgggaagtccaactgtcgacgtagacacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtagacacaggtctcactgagcgggctggcaaggc

SEQ ID NO: 2889 - DNA, 495 bp, Artificial Sequence
  source: /note="Description of Artificial Sequence: Synthetic polynucleotide"
gcctccctcgcgccatcaggtagacacgtcatagtcctgcccttctcatggaaccctctgctggcctcccacgtaccccacattctggcctgacccctcagaagccagaccactgtcggcctgggaagtccaactgtcgacgtagacacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtagacacgtcatagtctgagcgggctggcaaggc

SEQ ID NO: 2890 - DNA, 495 bp, Artificial Sequence
  source: /note="Description of Artificial Sequence: Synthetic polynucleotide"
gcctccctcgcgccatcaggtagacacgtgacttgcctgcccttctcatggaaccctctgctggcctcccacgtaccccacattctggcctgacccctcagaagccagaccactgtcggcctgggaagtccaactgtcgacgtagacacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtagacacgtgacttgctgagcgggctggcaaggc

SEQ ID NO: 2891 - DNA, 495 bp, Artificial Sequence
  source: /note="Description of Artificial Sequence: Synthetic polynucleotide"
gcctccctcgcgccatcaggtagacacgattgcagcctgcccttctcatggaaccctctgctggcctcccacgtaccccacattctggcctgacccctcagaagccagaccactgtcggcctgggaagtccaactgtcgacgtagacacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtagacacgattgcagctgagcgggctggcaaggc

SEQ ID NO: 2892 - DNA, 495 bp, Artificial Sequence
  source: /note="Description of Artificial Sequence: Synthetic polynucleotide"
gcctccctcgcgccatcaggtagacacactatgaccctgcccttctcatggaaccctctgctggcctcccacgtaccccacattctggcctgacccctcagaagccagaccactgtcggcctgggaagtccaactgtcgacgtagacacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtagacacactatgacctgagcgggctggcaaggc

SEQ ID NO: 2893 - DNA, 495 bp, Artificial Sequence
  source: /note="Description of Artificial Sequence: Synthetic polynucleotide"
gcctccctcgcgccatcaggtagacacatggtcaacctgcccttctcatggaaccctctgctggcctcccacgtaccccacattctggcctgacccctcagaagccagaccactgtcggcctgggaagtccaactgtcgacgtagacacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtagacacatggtcaactgagcgggctggcaaggc

SEQ ID NO: 2894 - DNA, 495 bp, Artificial Sequence
  source: /note="Description of Artificial Sequence: Synthetic polynucleotide"
gcctccctcgcgccatcaggtagacacgatggcttcctgcccttctcatggaaccctctgctggcctcccacgtaccccacattctggcctgacccctcagaagccagaccactgtcggcctgggaagtccaactgtcgacgtagacacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtagacacgatggcttctgagcgggctggcaaggc

SEQ ID NO: 2895 - DNA, 495 bp, Artificial Sequence
  source: /note="Description of Artificial Sequence: Synthetic polynucleotide"
gcctccctcgcgccatcaggtagacacagcatatgcctgcccttctcatggaaccctctgctggcctcccacgtaccccacattctggcctgacccctcagaagccagaccactgtcggcctgggaagtccaactgtcgacgtagacacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtagacacagcatatgctgagcgggctggcaaggc

SEQ ID NO: 2896 - DNA, 495 bp, Artificial Sequence
  source: /note="Description of Artificial Sequence: Synthetic polynucleotide"
gcctccctcgcgccatcaggtagacaccatatgctcctgcccttctcatggaaccctctgctggcctcccacgtaccccacattctggcctgacccctcagaagccagaccactgtcggcctgggaagtccaactgtcgacgtagacaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtagacaccatatgctctgagcgggctggcaaggc

SEQ ID NO: 2897 - DNA, 495 bp, Artificial Sequence
  source: /note="Description of Artificial Sequence: Synthetic polynucleotide"
gcctccctcgcgccatcaggtagacactcgtcgatcctgcccttctcatggaaccctctgctggcctcccacgtaccccacattctggcctgacccctcagaagccagaccactgtcggcctgggaagtccaactgtcgacgtagacactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtagacactcgtcgatctgagcgggctggcaaggc

SEQ ID NO: 2898 - DNA, 495 bp, Artificial Sequence
  source: /note="Description of Artificial Sequence: Synthetic polynucleotide"
gcctccctcgcgccatcaggtagacaccagtctgtcctgcccttctcatggaaccctctgctggcctcccacgtaccccacattctggcctgacccctcagaagccagaccactgtcggcctgggaagtccaactgtcgacgtagacaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtagacaccagtctgtctgagcgggctggcaaggc

SEQ ID NO: 2899 - DNA, 495 bp, Artificial Sequence
  source: /note="Description of Artificial Sequence: Synthetic polynucleotide"
gcctccctcgcgccatcaggtagacacaacgcgtacctgcccttctcatggaaccctctgctggcctcccacgtaccccacattctggcctgacccctcagaagccagaccactgtcggcctgggaagtccaactgtcgacgtagacacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtagacacaacgcgtactgagcgggctggcaaggc

SEQ ID NO: 2900 - DNA, 495 bp, Artificial Sequence
  source: /note="Description of Artificial Sequence: Synthetic polynucleotide"
gcctccctcgcgccatcaggtagacacgtagttcgcctgcccttctcatggaaccctctgctggcctcccacgtaccccacattctggcctgacccctcagaagccagaccactgtcggcctgggaagtccaactgtcgacgtagacacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtagacacgtagttcgctgagcgggctggcaaggc

SEQ ID NO: 2901 - DNA, 495 bp, Artificial Sequence
  source: /note="Description of Artificial Sequence: Synthetic polynucleotide"
gcctccctcgcgccatcaggtagacaccgaactaccctgcccttctcatggaaccctctgctggcctcccacgtaccccacattctggcctgacccctcagaagccagaccactgtcggcctgggaagtccaactgtcgacgtagacaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtagacaccgaactacctgagcgggctggcaaggc

SEQ ID NO: 2902 - DNA, 495 bp, Artificial Sequence
  source: /note="Description of Artificial Sequence: Synthetic polynucleotide"
gcctccctcgcgccatcaggtagacacttaacgtccctgcccttctcatggaaccctctgctggcctcccacgtaccccacattctggcctgacccctcagaagccagaccactgtcggcctgggaagtccaactgtcgacgtagacacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtagacacttaacgtcctgagcgggctggcaaggc

SEQ ID NO: 2903 - DNA, 495 bp, Artificial Sequence
  source: /note="Description of Artificial Sequence: Synthetic polynucleotide"
gcctccctcgcgccatcaggtagacacagcaacctcctgcccttctcatggaaccctctgctggcctcccacgtaccccacattctggcctgacccctcagaagccagaccactgtcggcctgggaagtccaactgtcgacgtagacacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtagacacagcaacctctgagcgggctggcaaggc

SEQ ID NO: 2904 - DNA, 495 bp, Artificial Sequence
  source: /note="Description of Artificial Sequence: Synthetic polynucleotide"
gcctccctcgcgccatcaggtagacacttctcgagcctgcccttctcatggaaccctctgctggcctcccacgtaccccacattctggcctgacccctcagaagccagaccactgtcggcctgggaagtccaactgtcgacgtagacacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtagacacttctcgagctgagcgggctggcaaggc

SEQ ID NO: 2905 - DNA, 495 bp, Artificial Sequence
  source: /note="Description of Artificial Sequence: Synthetic polynucleotide"
gcctccctcgcgccatcaggtagacacactctacgcctgcccttctcatggaaccctctgctggcctcccacgtaccccacattctggcctgacccctcagaagccagaccactgtcggcctgggaagtccaactgtcgacgtagacacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtagacacactctacgctgagcgggctggcaaggc

SEQ ID NO: 2906 - DNA, 495 bp, Artificial Sequence
  source: /note="Description of Artificial Sequence: Synthetic polynucleotide"
gcctccctcgcgccatcaggtagacactaccggaacctgcccttctcatggaaccctctgctggcctcccacgtaccccacattctggcctgacccctcagaagccagaccactgtcggcctgggaagtccaactgtcgacgtagacactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtagacactaccggaactgagcgggctggcaaggc

SEQ ID NO: 2907 - DNA, 495 bp, Artificial Sequence
  source: /note="Description of Artificial Sequence: Synthetic polynucleotide"
gcctccctcgcgccatcaggtagacaccgaattgccctgcccttctcatggaaccctctgctggcctcccacgtaccccacattctggcctgacccctcagaagccagaccactgtcggcctgggaagtccaactgtcgacgtagacaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtagacaccgaattgcctgagcgggctggcaaggc

SEQ ID NO: 2908 - DNA, 495 bp, Artificial Sequence
  source: /note="Description of Artificial Sequence: Synthetic polynucleotide"
gcctccctcgcgccatcaggtagacacttcgctcacctgcccttctcatggaaccctctgctggcctcccacgtaccccacattctggcctgacccctcagaagccagaccactgtcggcctgggaagtccaactgtcgacgtagacacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtagacacttcgctcactgagcgggctggcaaggc

SEQ ID NO: 2909 - DNA, 495 bp, Artificial Sequence
  source: /note="Description of Artificial Sequence: Synthetic polynucleotide"
gcctccctcgcgccatcaggtagacacgacgttaacctgcccttctcatggaaccctctgctggcctcccacgtaccccacattctggcctgacccctcagaagccagaccactgtcggcctgggaagtccaactgtcgacgtagacacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtagacacgacgttaactgagcgggctggcaaggc

SEQ ID NO: 2910 - DNA, 495 bp, Artificial Sequence
  source: /note="Description of Artificial Sequence: Synthetic polynucleotide"
gcctccctcgcgccatcaggtagacaccgtagagtcctgcccttctcatggaaccctctgctggcctcccacgtaccccacattctggcctgacccctcagaagccagaccactgtcggcctgggaagtccaactgtcgacgtagacaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtagacaccgtagagtctgagcgggctggcaaggc

SEQ ID NO: 2911 - DNA, 495 bp, Artificial Sequence
  source: /note="Description of Artificial Sequence: Synthetic polynucleotide"
gcctccctcgcgccatcaggtagacacttccggtacctgcccttctcatggaaccctctgctggcctcccacgtaccccacattctggcctgacccctcagaagccagaccactgtcggcctgggaagtccaactgtcgacgtagacacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtagacacttccggtactgagcgggctggcaaggc

SEQ ID NO: 2912 - DNA, 495 bp, Artificial Sequence
  source: /note="Description of Artificial Sequence: Synthetic polynucleotide"
gcctccctcgcgccatcaggtagacacgcaattcgcctgcccttctcatggaaccctctgctggcctcccacgtaccccacattctggcctgacccctcagaagccagaccactgtcggcctgggaagtccaactgtcgacgtagacacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtagacacgcaattcgctgagcgggctggcaaggc

SEQ ID NO: 2913 - DNA, 495 bp, Artificial Sequence
  source: /note="Description of Artificial Sequence: Synthetic polynucleotide"
gcctccctcgcgccatcaggtagacactgagcgaacctgcccttctcatggaaccctctgctggcctcccacgtaccccacattctggcctgacccctcagaagccagaccactgtcggcctgggaagtccaactgtcgacgtagacactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtagacactgagcgaactgagcgggctggcaaggc

SEQ ID NO: 2914 - DNA, 495 bp, Artificial Sequence
  source: /note="Description of Artificial Sequence: Synthetic polynucleotide"
gcctccctcgcgccatcaggtagacactactaagccctgcccttctcatggaaccctctgctggcctcccacgtaccccacattctggcctgacccctcagaagccagaccactgtcggcctgggaagtccaactgtcgacgtagacactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtagacactactaagcctgagcgggctggcaaggc

SEQ ID NO: 2915 - DNA, 495 bp, Artificial Sequence
  source: /note="Description of Artificial Sequence: Synthetic polynucleotide"
gcctccctcgcgccatcaggtagacactggcgtatcctgcccttctcatggaaccctctgctggcctcccacgtaccccacattctggcctgacccctcagaagccagaccactgtcggcctgggaagtccaactgtcgacgtagacactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtagacactggcgtatctgagcgggctggcaaggc

SEQ ID NO: 2916 - DNA, 495 bp, Artificial Sequence
  source: /note="Description of Artificial Sequence: Synthetic polynucleotide"
gcctccctcgcgccatcaggtagacacgataaccacctgcccttctcatggaaccctctgctggcctcccacgtaccccacattctggcctgacccctcagaagccagaccactgtcggcctgggaagtccaactgtcgacgtagacacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtagacacgataaccactgagcgggctggcaaggc

SEQ ID NO: 2917 - DNA, 495 bp, Artificial Sequence
  source: /note="Description of Artificial Sequence: Synthetic polynucleotide"
gcctccctcgcgccatcaggtagacacctagtgaacctgcccttctcatggaaccctctgctggcctcccacgtaccccacattctggcctgacccctcagaagccagaccactgtcggcctgggaagtccaactgtcgacgtagacacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtagacacctagtgaactgagcgggctggcaaggc

SEQ ID NO: 2918 - DNA, 495 bp, Artificial Sequence
  source: /note="Description of Artificial Sequence: Synthetic polynucleotide"
gcctccctcgcgccatcaggtagacacacgttcaccctgcccttctcatggaaccctctgctggcctcccacgtaccccacattctggcctgacccctcagaagccagaccactgtcggcctgggaagtccaactgtcgacgtagacacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtagacacacgttcacctgagcgggctggcaaggc

SEQ ID NO: 2919 - DNA, 448 bp, Artificial Sequence
  source: /note="Description of Artificial Sequence: Synthetic polynucleotide"
gcctccctcgcgccatcaggtagacacattacgctcctgcccttctcatggaaccctctgctggcctcccacgtaccccacattctggcctgacccctcagaagccagaccactgtcggcctgggaagtccaactgtcgacgtagacacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtagacacattacgctctgagcgggctggcaaggc

SEQ ID NO: 2920 - DNA, 495 bp, Artificial Sequence
  source: /note="Description of Artificial Sequence: Synthetic polynucleotide"
gcctccctcgcgccatcaggtagacaccattgagtcctgcccttctcatggaaccctctgctggcctcccacgtaccccacattctggcctgacccctcagaagccagaccactgtcggcctgggaagtccaactgtcgacgtagacaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtagacaccattgagtctgagcgggctggcaaggc

SEQ ID NO: 2921 - DNA, 300 bp, Artificial Sequence; identical to SEQ ID NO: 1749
  source: /note="Description of Artificial Sequence: Synthetic polynucleotide"

SEQ ID NO: 2922 - DNA, 300 bp, Artificial Sequence
  source: /note="Description of Artificial Sequence: Synthetic polynucleotide"
tctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcag

SEQ ID NO: 2923 - DNA, 300 bp, Artificial Sequence
  source: /note="Description of Artificial Sequence: Synthetic polynucleotide"
ttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcag

SEQ ID NO: 2924 - DNA, 300 bp, Artificial Sequence
  source: /note="Description of Artificial Sequence: Synthetic polynucleotide"
ttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcag

SEQ ID NO: 2925 - DNA, 300 bp, Artificial Sequence
  source: /note="Description of Artificial Sequence: Synthetic polynucleotide"
tcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcag

SEQ ID NO: 2926 - DNA, 300 bp, Artificial Sequence
  source: /note="Description of Artificial Sequence: Synthetic polynucleotide"
tccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcag

SEQ ID NO: 2927 - DNA, 300 bp, Artificial Sequence
  source: /note="Description of Artificial Sequence: Synthetic polynucleotide"
tccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcag

SEQ ID NO: 2928 - DNA, 300 bp, Artificial Sequence
  source: /note="Description of Artificial Sequence: Synthetic polynucleotide"
cttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagca

SEQ ID NO: 2929 - DNA, 300 bp, Artificial Sequence
  source: /note="Description of Artificial Sequence: Synthetic polynucleotide"
ttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagca

SEQ ID NO: 2930 - DNA, 300 bp, Artificial Sequence
  source: /note="Description of Artificial Sequence: Synthetic polynucleotide"
cttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaa

SEQ ID NO: 2931 - DNA, 300 bp, Artificial Sequence
  source: /note="Description of Artificial Sequence: Synthetic polynucleotide"
cttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagca

SEQ ID NO: 2932 - DNA, 300 bp, Artificial Sequence
  source: /note="Description of Artificial Sequence: Synthetic polynucleotide"
cttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagca

SEQ ID NO: 2933 - DNA, 300 bp, Artificial Sequence
  source: /note="Description of Artificial Sequence: Synthetic polynucleotide"
cttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagca

SEQ ID NO: 2934 - DNA, 300 bp, Artificial Sequence
  source: /note="Description of Artificial Sequence: Synthetic polynucleotide"
cttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagca

SEQ ID NO: 2935 - DNA, 300 bp, Artificial Sequence
  source: /note="Description of Artificial Sequence: Synthetic polynucleotide"
cttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagca

SEQ ID NO: 2936 - DNA, 300 bp, Artificial Sequence
  source: /note="Description of Artificial Sequence: Synthetic polynucleotide"
cttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcag

SEQ ID NO: 2937 - DNA, 300 bp, Artificial Sequence
  source: /note="Description of Artificial Sequence: Synthetic polynucleotide"
cttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcag

SEQ ID NO: 2938 - DNA, 300 bp, Artificial Sequence; identical to SEQ ID NO: 2937
  source: /note="Description of Artificial Sequence: Synthetic polynucleotide"

SEQ ID NO: 2939 - DNA, 300 bp, Artificial Sequence
  source: /note="Description of Artificial Sequence: Synthetic polynucleotide"
cttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcag

SEQ ID NO: 2940 - DNA, 300 bp, Artificial Sequence
  source: /note="Description of Artificial Sequence: Synthetic polynucleotide"
cttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcag

SEQ ID NO: 2941 - DNA, 300 bp, Artificial Sequence
  source: /note="Description of Artificial Sequence: Synthetic polynucleotide"
cttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcag

SEQ ID NO: 2942 - DNA, 300 bp, Artificial Sequence
  source: /note="Description of Artificial Sequence: Synthetic polynucleotide"
cttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcag

SEQ ID NO: 2943 - DNA, 300 bp, Artificial Sequence
  source: /note="Description of Artificial Sequence: Synthetic polynucleotide"
gttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcag

SEQ ID NO: 2944 - DNA, 300 bp, Artificial Sequence
  source: /note="Description of Artificial Sequence: Synthetic polynucleotide"
cttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcag

SEQ ID NO: 2945 - DNA, 300 bp, Artificial Sequence
  source: /note="Description of Artificial Sequence: Synthetic polynucleotide"
ctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcag

SEQ ID NO: 2946 - DNA, 300 bp, Artificial Sequence
  source: /note="Description of Artificial Sequence: Synthetic polynucleotide"
ctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcag

SEQ ID NO: 2947 - DNA, 300 bp, Artificial Sequence
  source: /note="Description of Artificial Sequence: Synthetic polynucleotide"
ctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcag

SEQ ID NO: 2948 - DNA, 300 bp, Artificial Sequence
  source: /note="Description of Artificial Sequence: Synthetic polynucleotide"
ttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcag

SEQ ID NO: 2949 - DNA, 300 bp, Artificial Sequence
  source: /note="Description of Artificial Sequence: Synthetic polynucleotide"
tttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaag

SEQ ID NO: 2950 - DNA, 300 bp, Artificial Sequence
  source: /note="Description of Artificial Sequence: Synthetic polynucleotide"
ttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcag

SEQ ID NO: 2951 - DNA, 300 bp, Artificial Sequence
  source: /note="Description of Artificial Sequence: Synthetic polynucleotide"
ttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcag

SEQ ID NO: 2952 - DNA, 300 bp, Artificial Sequence
  source: /note="Description of Artificial Sequence: Synthetic polynucleotide"
ttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcag

SEQ ID NO: 2953 - DNA, 300 bp, Artificial Sequence
  source: /note="Description of Artificial Sequence: Synthetic polynucleotide"
ctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcag

SEQ ID NO: 2954 - DNA, 300 bp, Artificial Sequence
  source: /note="Description of Artificial Sequence: Synthetic polynucleotide"
ctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcag

SEQ ID NO: 2955 - DNA, 300 bp, Artificial Sequence
  source: /note="Description of Artificial Sequence: Synthetic polynucleotide"
ttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcag

SEQ ID NO: 2956 - DNA, 300 bp, Artificial Sequence
  source: /note="Description of Artificial Sequence: Synthetic polynucleotide"
tctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagca

SEQ ID NO: 2957 - DNA, 300 bp, Artificial Sequence
  source: /note="Description of Artificial Sequence: Synthetic polynucleotide"
ctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcag

SEQ ID NO: 2958 - DNA, 300 bp, Artificial Sequence
  source: /note="Description of Artificial Sequence: Synthetic polynucleotide"
ctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcag

SEQ ID NO: 2959 - DNA, 300 bp, Artificial Sequence
  source: /note="Description of Artificial Sequence: Synthetic polynucleotide"
ttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcag

SEQ ID NO: 2960 - DNA, 300 bp, Artificial Sequence
  source: /note="Description of Artificial Sequence: Synthetic polynucleotide"
cccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcag

SEQ ID NO: 2961 - DNA, 300 bp, Artificial Sequence
  source: /note="Description of Artificial Sequence: Synthetic polynucleotide"
cttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcag

SEQ ID NO: 2962 - DNA, 300 bp, Artificial Sequence
  source: /note="Description of Artificial Sequence: Synthetic polynucleotide"
ccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcag

SEQ ID NO: 2963 - DNA, 300 bp, Artificial Sequence
  source: /note="Description of Artificial Sequence: Synthetic polynucleotide"
ttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcag

SEQ ID NO: 2964 - DNA, 300 bp, Artificial Sequence
  source: /note="Description of Artificial Sequence: Synthetic polynucleotide"
ttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcg

SEQ ID NO: 2965 - DNA, 300 bp, Artificial Sequence
  source: /note="Description of Artificial Sequence: Synthetic polynucleotide"
tttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcag

SEQ ID NO: 2966 - DNA, 300 bp, Artificial Sequence
  source: /note="Description of Artificial Sequence: Synthetic polynucleotide"
cttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcag

SEQ ID NO: 2967 - DNA, 300 bp, Artificial Sequence
  source: /note="Description of Artificial Sequence: Synthetic polynucleotide"
tttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtgg

SEQ ID NO: 2968 - DNA, 300 bp, Artificial Sequence
  source: /note="Description of Artificial Sequence: Synthetic polynucleotide"
ttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcag

SEQ ID NO: 2969 - DNA, 300 bp, Artificial Sequence
  source: /note="Description of Artificial Sequence: Synthetic polynucleotide"
tcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcag

SEQ ID NO: 2970 - DNA, 300 bp, Artificial Sequence
  source: /note="Description of Artificial Sequence: Synthetic polynucleotide"
tttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccag

SEQ ID NO: 2971 - DNA, 300 bp, Artificial Sequence
  source: /note="Description of Artificial Sequence: Synthetic polynucleotide"
ctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcag

SEQ ID NO: 2972 - DNA, 300 bp, Artificial Sequence
  source: /note="Description of Artificial Sequence: Synthetic polynucleotide"
ttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtag

SEQ ID NO: 2973 - DNA, 300 bp, Artificial Sequence
  source: /note="Description of Artificial Sequence: Synthetic polynucleotide"
cctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctc

SEQ ID NO: 2974 - DNA, 300 bp, Artificial Sequence
  source: /note="Description of Artificial Sequence: Synthetic polynucleotide"
ttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtag

SEQ ID NO: 2975 - DNA, 300 bp, Artificial Sequence
  source: /note="Description of Artificial Sequence: Synthetic polynucleotide"
aggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgc

SEQ ID NO: 2976 - DNA, 300 bp, Artificial Sequence
  source: /note="Description of Artificial Sequence: Synthetic polynucleotide"
ctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcag

SEQ ID NO: 2977 - DNA, 300 bp, Artificial Sequence
  source: /note="Description of Artificial Sequence: Synthetic polynucleotide"
ttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctggga

SEQ ID NO: 2978 - DNA, 300 bp, Artificial Sequence
  source: /note="Description of Artificial Sequence: Synthetic polynucleotide"
tcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcag

SEQ ID NO: 2979 - DNA, 300 bp, Artificial Sequence
  source: /note="Description of Artificial Sequence: Synthetic polynucleotide"
atttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagt

SEQ ID NO: 2980 - DNA, 300 bp, Artificial Sequence
  source: /note="Description of Artificial Sequence: Synthetic polynucleotide"
tcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcag

SEQ ID NO: 2981 - DNA, 300 bp, Artificial Sequence
  source: /note="Description of Artificial Sequence: Synthetic polynucleotide"
ccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcag

SEQ ID NO: 2982 - DNA, 300 bp, Artificial Sequence
  source: /note="Description of Artificial Sequence: Synthetic polynucleotide"
ttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcag

SEQ ID NO: 2983 - DNA, 300 bp, Artificial Sequence
  source: /note="Description of Artificial Sequence: Synthetic polynucleotide"
gtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcag

SEQ ID NO: 2984 - DNA, 300 bp, Artificial Sequence
  source: /note="Description of Artificial Sequence: Synthetic polynucleotide"
actaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgt

SEQ ID NO: 2985 - DNA, 300 bp, Artificial Sequence
  source: /note="Description of Artificial Sequence: Synthetic polynucleotide"
tatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctg

SEQ ID NO: 2986 - DNA, 300 bp, Artificial Sequence
  source: /note="Description of Artificial Sequence: Synthetic polynucleotide"
tctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccg

SEQ ID NO: 2987 - DNA, 300 bp, Artificial Sequence
  source: /note="Description of Artificial Sequence: Synthetic polynucleotide"
cagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatg

SEQ ID NO: 2988 - DNA, 300 bp, Artificial Sequence; identical to SEQ ID NO: 1749
  source: /note="Description of Artificial Sequence: Synthetic polynucleotide"

SEQ ID NO: 2989 - DNA, 100 bp, Artificial Sequence; identical to SEQ ID NO: 1750
  source: /note="Description of Artificial Sequence: Synthetic polynucleotide"

SEQ ID NO: 2990 - DNA, 100 bp, Artificial Sequence
  source: /note="Description of Artificial Sequence: Synthetic polynucleotide"
tatggctacaccttcggttcggggaccaggttaaccgttgtaggtaaggctgggggtctctaggaggggtgcgatgagggaggactctgtcctgggaaat

SEQ ID NO: 2991 - DNA, 100 bp, Artificial Sequence
  source: /note="Description of Artificial Sequence: Synthetic polynucleotide"
gaaacaccatatattttggagagggaagttggctcactgttgtaggtgagtaagtcaaggctggacagctgggaacttgcaaaaaggggctggaatccag

SEQ ID NO: 2992 - DNA, 100 bp, Artificial Sequence
  source: /note="Description of Artificial Sequence: Synthetic polynucleotide"
aatgaaaaactgttttttggcagtggaacccagctctctgtcttgggtatgtaaaagacttctttcgggatagtgtatcataaggtcggagttccaggag

SEQ ID NO: 2993 - DNA, 100 bp, Artificial Sequence
  source: /note="Description of Artificial Sequence: Synthetic polynucleotide"
atcagccccagcattttggtgatgggactcgactctccatcctaggtaagttgcagaatcagggtggtatggccattgtcccttgaaggcagagttctct

SEQ ID NO: 2994 - DNA, 100 bp, Artificial Sequence
  source: /note="Description of Artificial Sequence: Synthetic polynucleotide"
ataattcacccctccactttgggaacgggaccaggctcactgtgacaggtatgggggctccactcttgactcgggggtgcctgggtttgactgcaatgat

SEQ ID NO: 2995 - DNA, 100 bp, Artificial Sequence
  source: /note="Description of Artificial Sequence: Synthetic polynucleotide"
acaatgagcagttcttcgggccagggacacggctcaccgtgctaggtaagaagggggctccaggtgggagagagggtgagcagcccagcctgcacgaccc

SEQ ID NO: 2996 - DNA, 100 bp, Artificial Sequence
  source: /note="Description of Artificial Sequence: Synthetic polynucleotide"
accggggagctgttttttggagaaggctctaggctgaccgtactgggtaaggaggcggttggggctccggagagctccgagagggcgggatgggcagagg

SEQ ID NO: 2997 - DNA, 100 bp, Artificial Sequence
  source: /note="Description of Artificial Sequence: Synthetic polynucleotide"
agatacgcagtattttggcccaggcacccggctgacagtgctcggtaagcgggggctcccgctgaagccccggaactggggagggggcgccccgggacgc

SEQ ID NO: 2998 - DNA, 100 bp, Artificial Sequence
  source: /note="Description of Artificial Sequence: Synthetic polynucleotide"
aaaacattcagtacttcggcgccgggacccggctctcagtgctgggtaagctggggccgccgggggaccggggacgagactgcgctcgggtttttgtgcg

SEQ ID NO: 2999 - DNA, 100 bp, Artificial Sequence
  source: /note="Description of Artificial Sequence: Synthetic polynucleotide"
gagacccagtacttcgggccaggcacgcggctcctggtgctcggtgagcgcgggctgctggggcgcgggcgcgggcggcttgggtctggtttttgcgggg

SEQ ID NO: 3000 - DNA, 100 bp, Artificial Sequence
  source: /note="Description of Artificial Sequence: Synthetic polynucleotide"
gggccaacgtcctgactttcggggccggcagcaggctgaccgtgctgggtgagttttcgcgggaccacccgggcggcgggattcaggtggaaggcggcgg

SEQ ID NO: 3001 - DNA, 100 bp, Artificial Sequence
  source: /note="Description of Artificial Sequence: Synthetic polynucleotide"
acgagcagtacttcgggccgggcaccaggctcacggtcacaggtgagattcgggcgtctccccaccttccagcccctcggtccccggagtcggagggtgg

SEQ ID NO: 3002 - DNA, 300 bp, Artificial Sequence
  source: /note="Description of Artificial Sequence: Synthetic polynucleotide"
agtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctgg

SEQ ID NO: 3003 - DNA, 300 bp, Artificial Sequence
  source: /note="Description of Artificial Sequence: Synthetic polynucleotide"
cagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctgg

SEQ ID NO: 3004 - DNA, 300 bp, Artificial Sequence
  source: /note="Description of Artificial Sequence: Synthetic polynucleotide"
cagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctgg

SEQ ID NO: 3005 - DNA, 300 bp, Artificial Sequence
  source: /note="Description of Artificial Sequence: Synthetic polynucleotide"
cagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctgg

SEQ ID NO: 3006 - DNA, 300 bp, Artificial Sequence
  source: /note="Description of Artificial Sequence: Synthetic polynucleotide"
cagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgg

SEQ ID NO: 3007 - DNA, 300 bp, Artificial Sequence
  source: /note="Description of Artificial Sequence: Synthetic polynucleotide"
cagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctgg

SEQ ID NO: 3008 - DNA, 300 bp, Artificial Sequence
  source: /note="Description of Artificial Sequence: Synthetic polynucleotide"
agtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccacct

SEQ ID NO: 3009 - DNA, 300 bp, Artificial Sequence
  source: /note="Description of Artificial Sequence: Synthetic polynucleotide"
agtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccacct

SEQ ID NO: 3010 - DNA, 300 bp, Artificial Sequence
  source: /note="Description of Artificial Sequence: Synthetic polynucleotide"
cagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgg

SEQ ID NO: 3011 - DNA, 300 bp, Artificial Sequence
  source: /note="Description of Artificial Sequence: Synthetic polynucleotide"
gcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgg

SEQ ID NO: 3012 - DNA, 300 bp, Artificial Sequence
  source: /note="Description of Artificial Sequence: Synthetic polynucleotide"
ttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcg

SEQ ID NO: 3013 - DNA, 300 bp, Artificial Sequence
  source: /note="Description of Artificial Sequence: Synthetic polynucleotide"
gggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatt

SEQ ID NO: 3014 - DNA, 300 bp, Artificial Sequence
  source: /note="Description of Artificial Sequence: Synthetic polynucleotide"
tccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctgg

SEQ ID NO: 3015 - DNA, 300 bp, Artificial Sequence
  source: /note="Description of Artificial Sequence: Synthetic polynucleotide"
gcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctt

SEQ ID NO: 3016 - DNA, 100 bp, Artificial Sequence
  source: /note="Description of Artificial Sequence: Synthetic polynucleotide"
attataagaaactctttggcagtggaacaacacttgttgtcacaggtaagtatcggaagaatacaacatttccaaggtaatagagggaaggcaggaaatg

SEQ ID NO: 3017 - DNA, 100 bp, Artificial Sequence
  source: /note="Description of Artificial Sequence: Synthetic polynucleotide"
attataagaaactctttggcagtggaacaacacttgttgtcacaggtaagtatcggaagaatacaacatttccaaggtaatagagggaaagcaggaaatt

SEQ ID NO: 3018 - DNA, 100 bp, Artificial Sequence
  source: /note="Description of Artificial Sequence: Synthetic polynucleotide"
aagagttgggcaaaaaaatcaaggtatttggtcccggaacaaagcttatcattacaggtaagttttctttaaattttgcaatgtaaagaagggatgggag

SEQ ID NO: 3019 - DNA, 100 bp, Artificial Sequence
  source: /note="Description of Artificial Sequence: Synthetic polynucleotide"
actggttggttcaagatatttgctgaagggactaagctcatagtaacttcacctggtaagtaacttttctttctgtttttattccagtaatgaaaaactg

SEQ ID NO: 3020 - DNA, 100 bp, Artificial Sequence
  source: /note="Description of Artificial Sequence: Synthetic polynucleotide"
agtgattggatcaagacgtttgcaaaagggactaggctcatagtaacttcgcctggtaagtaattttttttctgtttttattccagtaatgaaaaactga

SEQ ID NO: 3021 - DNA, 300 bp, Artificial Sequence
  source: /note="Description of Artificial Sequence: Synthetic polynucleotide"
agcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgc

SEQ ID NO: 3022 - DNA, 300 bp, Artificial Sequence
  source: /note="Description of Artificial Sequence: Synthetic polynucleotide"
tgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgc

SEQ ID NO: 3023 - DNA, 300 bp, Artificial Sequence
  source: /note="Description of Artificial Sequence: Synthetic polynucleotide"
tgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgc

SEQ ID NO: 3024 - DNA, 300 bp, Artificial Sequence
  source: /note="Description of Artificial Sequence: Synthetic polynucleotide"
tgcccactcccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgc

SEQ ID NO: 3025 - DNA, 300 bp, Artificial Sequence
  source: /note="Description of Artificial Sequence: Synthetic polynucleotide"
cacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgc

SEQ ID NO: 3026 - DNA, 300 bp, Artificial Sequence
  source: /note="Description of Artificial Sequence: Synthetic polynucleotide"
tgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgc

SEQ ID NO: 3027 - DNA, 300 bp, Artificial Sequence
  source: /note="Description of Artificial Sequence: Synthetic polynucleotide"
tgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgc

SEQ ID NO: 3028 - DNA, 300 bp, Artificial Sequence
  source: /note="Description of Artificial Sequence: Synthetic polynucleotide"
tgcccactcccaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgc

SEQ ID NO: 3029 - DNA, 300 bp, Artificial Sequence
  source: /note="Description of Artificial Sequence: Synthetic polynucleotide"
tgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgc

SEQ ID NO: 3030 - DNA, 300 bp, Artificial Sequence
  source: /note="Description of Artificial Sequence: Synthetic polynucleotide"
tgcccactcccaggtccagctggtgcagtcttgggctgaggtgaggaagtctggggcctcagtgaaagtctcctgtagtttttctgggtttaccatcaccagctacggtatacattgggtgcaacagtcccctggacaagggcttgagtggatgggatggatcaaccctggcaatggtagcccaagctatgccaagaagtttcagggcagattcaccatgaccagggacatgtccacaaccacagcctacacagacctgagcagcctgacatctgaggacatggctgtgtattactatgc

SEQ ID NO: 3031 - DNA, 300 bp, Artificial Sequence
  source: /note="Description of Artificial Sequence: Synthetic polynucleotide"
cacccacgccgaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgc

SEQ ID NO: 3032 - DNA, 300 bp, Artificial Sequence
  source: /note="Description of Artificial Sequence: Synthetic polynucleotide"
tgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcac

SEQ ID NO: 3033 - DNA, 300 bp, Artificial Sequence
  source: /note="Description of Artificial Sequence: Synthetic polynucleotide"
tgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcac

SEQ ID NO: 3034 - DNA, 300 bp, Artificial Sequence
  source: /note="Description of Artificial Sequence: Synthetic polynucleotide"
tatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcac

SEQ ID NO: 3035 - DNA, 300 bp, Artificial Sequence
  source: /note="Description of Artificial Sequence: Synthetic polynucleotide"
tgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgc

SEQ ID NO: 3036 - DNA, 300 bp, Artificial Sequence
  source: /note="Description of Artificial Sequence: Synthetic polynucleotide"
tccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaa

SEQ ID NO: 3037 - DNA, 300 bp, Artificial Sequence
  source: /note="Description of Artificial Sequence: Synthetic polynucleotide"
tgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgc

SEQ ID NO: 3038 - DNA, 300 bp, Artificial Sequence
  source: /note="Description of Artificial Sequence: Synthetic polynucleotide"
aggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgc

SEQ ID NO: 3039 - DNA, 300 bp, Artificial Sequence
  source: /note="Description of Artificial Sequence: Synthetic polynucleotide"
gtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtac

SEQ ID NO: 3040 - DNA, 300 bp, Artificial Sequence
  source: /note="Description of Artificial Sequence: Synthetic polynucleotide"
tgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgt

SEQ ID NO: 3041 - DNA, 300 bp, Artificial Sequence
  source: /note="Description of Artificial Sequence: Synthetic polynucleotide"
tgtccagtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgc

SEQ ID NO: 3042 - DNA, 300 bp, Artificial Sequence
  source: /note="Description of Artificial Sequence: Synthetic polynucleotide"
tgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgc

SEQ ID NO: 3043 - DNA, 300 bp, Artificial Sequence
  source: /note="Description of Artificial Sequence: Synthetic polynucleotide"
tgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgc

SEQ ID NO: 3044 - DNA, 300 bp, Artificial Sequence
  source: /note="Description of Artificial Sequence: Synthetic polynucleotide"
tgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgc

SEQ ID NO: 3045 - DNA, 300 bp, Artificial Sequence; identical to SEQ ID NO: 3044
  source: /note="Description of Artificial Sequence: Synthetic polynucleotide"

SEQ ID NO: 3046 - DNA, 300 bp, Artificial Sequence
  source: /note="Description of Artificial Sequence: Synthetic polynucleotide"
tgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgc

SEQ ID NO: 3047 - DNA, 300 bp, Artificial Sequence
  source: /note="Description of Artificial Sequence: Synthetic polynucleotide"
tgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgt

SEQ ID NO: 3048 - DNA, 300 bp, Artificial Sequence
  source: /note="Description of Artificial Sequence: Synthetic polynucleotide"
tgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgc

SEQ ID NO: 3049 - DNA, 300 bp, Artificial Sequence
  source: /note="Description of Artificial Sequence: Synthetic polynucleotide"
tccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaa

SEQ ID NO: 3050 - DNA, 300 bp, Artificial Sequence
  source: /note="Description of Artificial Sequence: Synthetic polynucleotide"
tgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgc

SEQ ID NO: 3051 - DNA, 300 bp, Artificial Sequence
  source: /note="Description of Artificial Sequence: Synthetic polynucleotide"
atgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtac

SEQ ID NO: 3052 - DNA, 300 bp, Artificial Sequence
  source: /note="Description of Artificial Sequence: Synthetic polynucleotide"
aggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgc

SEQ ID NO: 3053 - DNA, 300 bp, Artificial Sequence
  source: /note="Description of Artificial Sequence: Synthetic polynucleotide"
tgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgc

SEQ ID NO: 3054 - DNA, 300 bp, Artificial Sequence
  source: /note="Description of Artificial Sequence: Synthetic polynucleotide"
aggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgc

SEQ ID NO: 3055 - DNA, 300 bp, Artificial Sequence
  source: /note="Description of Artificial Sequence: Synthetic polynucleotide"
gtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgc

SEQ ID NO: 3056 - DNA, 300 bp, Artificial Sequence
  source: /note="Description of Artificial Sequence: Synthetic polynucleotide"
gtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtac

SEQ ID NO: 3057 - DNA, 300 bp, Artificial Sequence
  source: /note="Description of Artificial Sequence: Synthetic polynucleotide"
tgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgc

SEQ ID NO: 3058 - DNA, 300 bp, Artificial Sequence
  source: /note="Description of Artificial Sequence: Synthetic polynucleotide"
tgtccagtgtcaggtgcagctggtggagtctgggggaggcgtggtccagcctggggggtccctgagactctcctgtgcagcgtctggattcaccttcagtagctatggcatgcactgggtccgccaggctccaggcaaggggctggagtgggtggcatttatacggtatgatggaagtaataaatactatgcagactccgtgaagggccgattcaccatctccagagacaattccaagaacacgctgtatctgcaaatgaacagcctgagagctgaggacacggctgtgtattactgtgc

SEQ ID NO: 3059 - DNA, 300 bp, Artificial Sequence
  source: /note="Description of Artificial Sequence: Synthetic polynucleotide"
tgcaggtgtccagtgtgaggtgcagctggtggagtctcggggagtcttggtacagcctggggggtccctgagactctcctgtgcagcctctggattcaccgtcagtagcaatgagatgagctgggtccgccaggctccagggaagggtctggagtgggtctcatccattagtggtggtagcacatactacgcagactccaggaagggcagattcaccatctccagagacaattccaagaacacgctgcatcttcaaatgaacagcctgagagctgaggacacggctgtgtattactgtaa

SEQ ID NO: 3060 - DNA, 300 bp, Artificial Sequence
  source: /note="Description of Artificial Sequence: Synthetic polynucleotide"
aggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgc

SEQ ID NO: 3061 - DNA, 300 bp, Artificial Sequence
  source: /note="Description of Artificial Sequence: Synthetic polynucleotide"
ggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgc

SEQ ID NO: 3062 - DNA, 300 bp, Artificial Sequence
  source: /note="Description of Artificial Sequence: Synthetic polynucleotide"
cctgtcccagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgc

SEQ ID NO: 3063 - DNA, 300 bp, Artificial Sequence
  source: /note="Description of Artificial Sequence: Synthetic polynucleotide"
cctgtcccaggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgc

SEQ ID NO: 3064 - DNA, 300 bp, Artificial Sequence
  source: /note="Description of Artificial Sequence: Synthetic polynucleotide"
cctgccccaggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgc

SEQ ID NO: 3065 - DNA, 300 bp, Artificial Sequence
  source: /note="Description of Artificial Sequence: Synthetic polynucleotide"
aggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgc

SEQ ID NO: 3066 - DNA, 300 bp, Artificial Sequence
  source: /note="Description of Artificial Sequence: Synthetic polynucleotide"
cctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgc

SEQ ID NO: 3067 - DNA, 300 bp, Artificial Sequence
  source: /note="Description of Artificial Sequence: Synthetic polynucleotide"
aggggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgc

SEQ ID NO: 3068 - DNA, 300 bp, Artificial Sequence
  source: /note="Description of Artificial Sequence: Synthetic polynucleotide"
cctgtcccaggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgc

SEQ ID NO: 3069 - DNA, 300 bp, Artificial Sequence
  source: /note="Description of Artificial Sequence: Synthetic polynucleotide"
ggtcctgtcccaggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgc

SEQ ID NO: 3070 - DNA, 300 bp, Artificial Sequence
  source: /note="Description of Artificial Sequence: Synthetic polynucleotide"
agtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgc

SEQ ID NO: 3071 - DNA, 300 bp, Artificial Sequence
  source: /note="Description of Artificial Sequence: Synthetic polynucleotide"
agtctgtgccgaagtgcagctggtgcagtctggagcagaggtgaaaaagcccggggagtctctgaggatctcctgtaagggttctggatacagctttaccagctactggatcagctgggtgcgccagatgcccgggaaaggcttggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgc

SEQ ID NO: 3072 - DNA, 300 bp, Artificial Sequence
  source: /note="Description of Artificial Sequence: Synthetic polynucleotide"
acaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgc

SEQ ID NO: 3073 - DNA, 300 bp, Artificial Sequence
  source: /note="Description of Artificial Sequence: Synthetic polynucleotide"
tgcccactcccaggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatctgcagcctaaaggctgaggacactgccgtgtattactgtgc

SEQ ID NO: 3074 - DNA, 300 bp, Artificial Sequence
  source: /note="Description of Artificial Sequence: Synthetic polynucleotide"
tacctactcccaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgc

SEQ ID NO: 3075 - DNA, 300 bp, Artificial Sequence
  source: /note="Description of Artificial Sequence: Synthetic polynucleotide"
gaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattccc

SEQ ID NO: 3076 - DNA, 300 bp, Artificial Sequence
  source: /note="Description of Artificial Sequence: Synthetic polynucleotide"
cctatgaaaaaaattgtgtttttcagtgcactcatgttctagtaaagccctcagagaccctctccttcacctgtgctgtctctggatttccaatcataaccagtacttcctcctggagctgtatctgccagcccccagggaagaagctgaagtgggtcaggtgtgtaggtcacgaggaaacacacagtgcaacccgcttctcaagagtccagtcaccacctccagatccacattcagaaaacagtttttcctacagctgagctacccgcacaatgagtaaaccaccatggatttttatac

SEQ ID NO: 3077 - DNA, 300 bp, Artificial Sequence
  source: /note="Description of Artificial Sequence: Synthetic polynucleotide"
tgtgcatgccgacaactgtgattctcggtgcactcctggcctggtgaagccctcacagatcctccccctggcctgtggcatctctgcttctccattacaaccagtgcttcctgctggagctggatccgtcaccccccggggaagggactggagcgaatcaggtgcacaggtcatgagggagtgcacaatccaacccactcctcaagagtccagtcaccatctccagatccacatccaaaaaacagtttctcctacagctgagctaccttaacaaggagtacacaaccatgatttttatac

SEQ ID NO: 3078 - DNA, 300 bp, Artificial Sequence
  source: /note="Description of Artificial Sequence: Synthetic polynucleotide"
gtcccaggtgcagctgcaggagtcaggtccaggacccatgaggccctcagacactgccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgt

SEQ ID NO: 3079 - DNA, 300 bp, Artificial Sequence
  source: /note="Description of Artificial Sequence: Synthetic polynucleotide"
tgtgttgcccagaacctgttaacatcaacaactatgtttctcagcacacttctggcttgagactccttgcagaccctctcctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagc

SEQ ID NO: 3080 - DNA, 300 bp, Artificial Sequence
  source: /note="Description of Artificial Sequence: Synthetic polynucleotide"
ctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagc

SEQ ID NO: 3081 - DNA, 300 bp, Artificial Sequence
  source: /note="Description of Artificial Sequence: Synthetic polynucleotide"
tgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagc

SEQ ID NO: 3082 - DNA, 300 bp, Artificial Sequence
  source: /note="Description of Artificial Sequence: Synthetic polynucleotide"
ctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagc

SEQ ID NO: 3083 - DNA, 300 bp, Artificial Sequence
  source: /note="Description of Artificial Sequence: Synthetic polynucleotide"
gggtttccaatgtatcatccagaacttgtgcatgctaacaactgtttttctcagtcaattatcagcctggtgaagcccttgcaaaccccctcactcacctgtgctgcctctggattctctgtcacaatcagtgcttcctgtaggcactggatggaaagcacaggagtgggtcaggtgcatacgtgatgagtggaggatgaattccagcccacttatcatgaattcagacaagcccacatgttcccacatgcactatatcttcagacaagcagatgtgtctgcacatgaattcttctttca

SEQ ID NO: 3084 - DNA, 300 bp, Artificial Sequence
  source: /note="Description of Artificial Sequence: Synthetic polynucleotide"
ctgagattgacaggcttacaagtgtcttagtccagcagttttcggtaacaggctatccactttcattttctcttcctcacatgccccatttctgggttgtccatcccaaccaacagttactgctggagctgaatccactagcccgcttccatgggctgtcaggaacacattgcaagggtgacacacacgatgatccatctctgcagagccaactctccttctccagagattcatccaagaaacaattttgactatacctgagctctgtgacatctgaggacatggtttgtattactgtgc

SEQ ID NO: 3085 - DNA, 300 bp, Artificial Sequence
  source: /note="Description of Artificial Sequence: Synthetic polynucleotide"
agctgcaggagtcagccctggacctgaatagcacacacttaccctctgcctcacctacactgttactggccactccgtcacaaccagtccttactagtggacctggatctgccggctctcagggaggggctgcaatggataaaatccattgctagtggtggtgggagtccatttgtcttgtggaaaatggcagcatttccttattttataaggcataataatgctatgttgtgtacacataccacattgtctttatccatttgcccattgacagacacttagtttccatatcttggctgt

SEQ ID NO: 3086 - DNA, 300 bp, Artificial Sequence
  source: /note="Description of Artificial Sequence: Synthetic polynucleotide"
gtgcatgccgacatctgtatttctcgtgcgttcttggcctggcgaagccctcacagaccctctccctcatctgtgctgtctctgcttctccatcacaaccagtgcttcctgctggagctggatccctcagctccccagggaagggactggagtgaatcaggtgcacaggtcatgagggagaacacaacgcaacccacgcctcaagagtccagtcaccatctccagatccacatccaaaacacagtttcttctacagctgagctacctgagcaacgagtacacaaccatgaatttttacac

SEQ ID NO: 3087 - DNA, 300 bp, Artificial Sequence
  source: /note="Description of Artificial Sequence: Synthetic polynucleotide"
ccagaagccatgcacaccaaccactgtgtttcatggtcatttattggcctggtgaggccctcacagaccccctccctcacctgtgctgtctctggattctccatcacaactagtgcttcctgctggagctggatccgccagtcctcagtcaagggagtggatcagggcataggtcacgagggagcacaaattctaacccactcctcatgagctcagtcaccatctccagatccacgtccaagaaccaaattttcttttagctgagttctgtgaccaacaatgccacaaccttgtattact

SEQ ID NO: 3088 - DNA, 300 bp, Artificial Sequence
  source: /note="Description of Artificial Sequence: Synthetic polynucleotide"
gtgcatgccaacaactgtgtttctcagtgcccacttggcctggtgaagccctcacagaccctctccctcacctgtgctgtctctggattccccatcacaaccagtgcttcctgctgtagctgcattcataaaccccccaggaagggactggagtgaatccagtgcacaggtcatgagggagtgcacattccaacccactcctcaagagtccagtcaccatctccagatccatgtccaaaaagcagttcttcctacagccgagctaagtgagtcacaagcacacagccatgtatttttaac

SEQ ID NO: 3089 - DNA, 300 bp, Artificial Sequence
  source: /note="Description of Artificial Sequence: Synthetic polynucleotide"
tgtgctcacaaacaactgtgtttcttagtgcactcttggcctggtggagccctcgcagaccctctccctcacctgtgctgtctctggattttccatcacaaccagtgtttcctgctggagctggatccacgagtccacatgggaaggactggagtggaccaggcgcacacgtcatgaagggagcaaaaattcccacccactccttatgaatccagtcaccatctccaaattcgggtccaaaaaacacttgtttttacagtggagctatgtgagcaacaagctcacagccatgttttaaag

SEQ ID NO: 3090 - DNA, 300 bp, Artificial Sequence
  source: /note="Description of Artificial Sequence: Synthetic polynucleotide"
cctgccaacaactgtgtttctcggtgcactcttggcctggtgaagcccccaaagaccctctccctcatgtgtgtcatctctgcattctccatcacaaccagtgcttcctcctggatctgcatccatcaccccctctctgggagggaatggagtggattgggtccatagatgatgaagggagcacacattactcccctttcctcaagagtccagtcaccatccccagatccatgtccaaaaacagttcttcctacagctgagctacatgagcaacaatcacatagccatatatttttcagc

SEQ ID NO: 3091 - DNA, 300 bp, Artificial Sequence
  source: /note="Description of Artificial Sequence: Synthetic polynucleotide"
gcatgccaacaactgtgtttctcctgcactcttgggctagtgaagctctcacagaccctctctctcacctgtgctgtctctgcattctccatcacaaccagtgcttcctgctggagctgcatccatcaccccccgcaaggaagggactggagcgaatcaggtgcacaggtcatgagggagtgcacattccaacccactcctcaagagtccagtcactatctccagatccacatccaaaaaacagtgtttcctgtagctgagctacctgagcaacaagtacacaaccatgaattttaatac

SEQ ID NO: 3092 - DNA, 300 bp, Artificial Sequence
  source: /note="Description of Artificial Sequence: Synthetic polynucleotide"
atgccaacaactgtgtttctcagcgcactcttggcctggtgaagccctcacagaccctctcccttacctgcgctgtgtctgtgttccccgtgataacgaggtcttcctgctgaagctggatccatcagccccccagggaagggaatggagtggattgggtgcataggtcatgaagggagcacacattaccacccactcctcaagtgtccagtcaccatccccagatccgtgtccaaaaaagcagttcttcctacagctgagctacatgagcaacaagcacatagccatgtatttttaagc

SEQ ID NO: 3093 - DNA, 300 bp, Artificial Sequence
  source: /note="Description of Artificial Sequence: Synthetic polynucleotide"
acggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgt

SEQ ID NO: 3094 - DNA, 149 bp, Artificial Sequence
  source: /note="Description of Artificial Sequence: Synthetic polynucleotide"
aatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaag

SEQ ID NO: 3095 - DNA, 300 bp, Artificial Sequence
  source: /note="Description of Artificial Sequence: Synthetic polynucleotide"
aaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgt

SEQ ID NO: 3096 - DNA, 300 bp, Artificial Sequence
  source: /note="Description of Artificial Sequence: Synthetic polynucleotide"
ttttcagaagtcccctgtgaagttaactaatggagttagacagagaaatactacagaccaggaattctgccttttctgcaaagcctctggattcactttcactgaaaacagcataagcttgatccagcaggcttcatgacaggggtgggtgtgggtaataacaataattcaaatagaagttctcagtgggactctccttgagtaaaaagatgattaacaatcctcaaatacactcagttcaggagattctcttttaagatgattaacctgagagctcaggaaaagtccgtgtattacttt

SEQ ID NO: 3097 - DNA, 300 bp, Artificial Sequence
  source: /note="Description of Artificial Sequence: Synthetic polynucleotide"
gaagtcctgtgtgaaatttactgatagagtcaggggggaaaattgtacagcccagtggttcactgagactctcatgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttaaagggaccaaactgaaagtcaaggacaaggccttgtaatactgt

SEQ ID NO: 3098 - DNA, 300 bp, Artificial Sequence
  source: /note="Description of Artificial Sequence: Synthetic polynucleotide"
agtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagt

SEQ ID NO: 3099 - DNA, 300 bp, Artificial Sequence
  source: /note="Description of Artificial Sequence: Synthetic polynucleotide"
tctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgt

SEQ ID NO: 3100 - DNA, 300 bp, Artificial Sequence
  source: /note="Description of Artificial Sequence: Synthetic polynucleotide"
tccatgggttacaaaataatgggttggcttttcttccaacactttacagacaccatcaattttcctcttgcttataaggttttaaccagaagaatgctgtcatcatctttcctgttcttttagaaagaatgccccctcaactcatctccacttgtctgcatgtatttctatttgtctttggttttcagcagttttaataagattcacctaaatgtgtgtgtgtgtgtcgaggggtgttatgctattgttctgtgttctctgagatgcatggattcaccgtttactctgtctccatttttg

SEQ ID NO: 3101 - DNA, 300 bp, Artificial Sequence
  source: /note="Description of Artificial Sequence: Synthetic polynucleotide"
agaggtcccctgtgaagttaattactggagtctctcagagaaatactacagaccaagaattctcagacttttctggaaaccctgtggattcactttcactgaaaacagcataagcttggtccagcaggcttcatgacaggggtgggtgtaggtgataacatcagtaattcaagtggaagttctcagtgggactctccttgagtacaaagaagattaacagtcctcagagacacgcttttcagatgattctctcttaagatgattaacctgagagctcaggaaaattccgtttattactgt

SEQ ID NO: 3102 - DNA, 300 bp, Artificial Sequence
  source: /note="Description of Artificial Sequence: Synthetic polynucleotide"
tatccagggtgaggcccagcttacagagtctgggggagacttggtacactgagaggggcccctgaggctctcctgtgcagcctcttggttcaccttcagtatctatgagattcactgggtttgccaggcctcagggaaggggctggaatgggttgcagttatatggcgtagtgaaagtcatcaatacaatgcagactatgttaggggcagactcaccacttccagagacaacaccaagtacatgctgtacatgcaaatgaacagcctgagaacccagaacatggcagcatttaactgtgc

SEQ ID NO: 3103 - DNA, 149 bp, Artificial Sequence
  source: /note="Description of Artificial Sequence: Synthetic polynucleotide"
aataggttttctcaggttttattggtccgacagaatatttatttgtctttgatttattgtctccagagacaatgtcaagaatatgctatatctgcaaatgggcgatctgtaaaccaagaacacatcagtatatcactgtgcaagaggag

SEQ ID NO: 3104 - DNA, 300 bp, Artificial Sequence
  source: /note="Description of Artificial Sequence: Synthetic polynucleotide"
tactggatctatatttttatctttggcaaaacagcctggctgttctcttagcctcttttgcaaagcatcaagattcaccttcactgactacagcataaattgagcccagatggctgggggacagaggctggagtgggtggtaacagtgattgattcaagtggaagttctcagtgatattctgcatcagcataatgaagattcacaattcccagggacaccaattaccagcacagtctcccttaaaataatctacttggaagctgagggggctctcacaggggtaggcagtgtattactgt

SEQ ID NO: 3105 - DNA, 300 bp, Artificial Sequence
  source: /note="Description of Artificial Sequence: Synthetic polynucleotide"
aagtcctgtatgaagttcagtggtggagtcagaggggtaaacgtagtacagcccagtggttcactgagactttcttgcaaagcgtctggattcaccttttctggcaacagcctgaggttggtccagcaggcttcacaacagggattgtggtggctggcaacagtgagtcaacaagtgggagtgctcaggtttactcttcatgagtacaaataaattaactggtccagcgacaccctttcacgtgcactctaccttacaatgactaacctgaaagccaaggacaaggttgtgtaatactgt

SEQ ID NO: 3106 - DNA, 300 bp, Artificial Sequence
  source: /note="Description of Artificial Sequence: Synthetic polynucleotide"
agtcctacaagaagttcactggtggaatctggaagagaaatgatacagcctaactgttctcagagccttttttacaaagcctctgaatttaccttcattgactctagcatgagctcagcccagcaggcttcaggacaggggttggtgtgggaggcaaaagcgagggattcaagtggaatttgttagtggtaccctccatcaatacaaagaaaaatcataatcctcagggacacccttgtcagcacagtctccctcaaaatgaccaacctgagagccgaggagaaggccatgtattactgt

SEQ ID NO: 3107 - DNA, 300 bp, Artificial Sequence
  source: /note="Description of Artificial Sequence: Synthetic polynucleotide"
ctctgtgttcatgtaagtcctgttgaagcttactgatggagtcagagggggaaacattgtacagcccagcggttctcacagactctcctgcaaagcctctgatttcacttgtactggctacagcatgagcttggtccagcaggcttcatgacagggatttgtgtgggtggcaacagtgagttatcagggttactctccatgagtacaagtaaattaacagtcccaagcaacaccctttcaagtgcagtctaccttaaaatgaccaatgtgaaagccaaggacaagaccttgtattactgt

SEQ ID NO: 3108 - DNA, 300 bp, Artificial Sequence
  source: /note="Description of Artificial Sequence: Synthetic polynucleotide"
tctcaggggttcacagtgaggaccaccttgtgcaatgggaggaagaagtagtggtccccttggtcatgctcagcctcacctatgccgcctatgcacattcaatttctgaacattctgtttcctggatccaccatctcccatcaaaaggtcttcagtgtgttggtgtgatatgggttaagggaaacactaagccccaaccttcagggcagagctagcatctccagaaacacatagtaaaaaacaagaaaacttacagctgagaagtgtgatggctggggatgcaggcgtgtattactgtgc

SEQ ID NO: 3109 - DNA, 300 bp, Artificial Sequence
  source: /note="Description of Artificial Sequence: Synthetic polynucleotide"
tcctgattatatgactcacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgc

SEQ ID NO: 3110 - DNA, 300 bp, Artificial Sequence
  source: /note="Description of Artificial Sequence: Synthetic polynucleotide"
tgtccattcccaggttcagctgttgcagcctggggctgaggtgaagaagcctgcgtcctcagtgaaggtctcctggccaggcttccagatacaccttcaccaaatactttacacagtgggtgcgacagggccctggacaagggcatagtggttgggatgcatcaacccttacaatgataacacacactacgcacagaagttccggggcagagtcaccattaccagtgacaggtccgtgagcacagcctacatggagctgagcagcctgagatctgaagacatggtcgtgtattcctgtgt

SEQ ID NO: 3111 - DNA, 300 bp, Artificial Sequence
  source: /note="Description of Artificial Sequence: Synthetic polynucleotide"
cagtcccaggtgcagctggtgcagtctggggatgagatgaagaaggctggggcatcagtgaaagtctcctgcaagacttgtggatacacctaccttcaccagttactctatgcactaggtgcgccaggcccatgcacaagggcttgagtggatgggaaggatgtgccctagtgatggcagcataagctacgcagagaagttccagggcagagtcaccatgaccagggacacatccacgagcacagcctacatggagctgagcagcctgagatctgaagacacggccatgtattactgtgg

SEQ ID NO: 3112 - DNA, 300 bp, Artificial Sequence
  source: /note="Description of Artificial Sequence: Synthetic polynucleotide"
tgtctgctcccaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggc

SEQ ID NO: 3113 - DNA, 300 bp, Artificial Sequence
  source: /note="Description of Artificial Sequence: Synthetic polynucleotide"
gtgtccattcccaggttcagctgttgcagcctggggctgaggtgaagaagcctgggtcctcagtgaaggtctcctgccaggcttccagatacaccttcaccaaatactttacacggtgggtgtgacaaagccctggacaagggcatagtggatgggatgaatcaacccttacaatgataacacacactatgcacagacgttctggggcagagtcaccattaccagtgacaggtccatgagcacagcctacatggagctgagcagcctgagatctgaagacatggtcgtgtattactgtgt

SEQ ID NO: 3114 - DNA, 300 bp, Artificial Sequence
  source: /note="Description of Artificial Sequence: Synthetic polynucleotide"
tatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaa

SEQ ID NO: 3115 - DNA, 300 bp, Artificial Sequence
  source: /note="Description of Artificial Sequence: Synthetic polynucleotide"
gtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgt

SEQ ID NO: 3116 - DNA, 300 bp, Artificial Sequence
  source: /note="Description of Artificial Sequence: Synthetic polynucleotide"
cctgggtacaacagtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgt

SEQ ID NO: 3117 - DNA, 300 bp, Artificial Sequence
  source: /note="Description of Artificial Sequence: Synthetic polynucleotide"
gtgtgaggtgcagctggtggagtctgggggaggcttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttc

SEQ ID NO: 3118 - DNA, 300 bp, Artificial Sequence
  source: /note="Description of Artificial Sequence: Synthetic polynucleotide"
tatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtac

SEQ ID NO: 3119 - DNA, 300 bp, Artificial Sequence
  source: /note="Description of Artificial Sequence: Synthetic polynucleotide"
ttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacat

SEQ ID NO: 3120 - DNA, 300 bp, Artificial Sequence
  source: /note="Description of Artificial Sequence: Synthetic polynucleotide"
tctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgt

SEQ ID NO: 3121 - DNA, 300 bp, Artificial Sequence
  source: /note="Description of Artificial Sequence: Synthetic polynucleotide"
ttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacat

SEQ ID NO: 3122 - DNA, 300 bp, Artificial Sequence
  source: /note="Description of Artificial Sequence: Synthetic polynucleotide"
tctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgt

SEQ ID NO: 3123 - DNA, 300 bp, Artificial Sequence
  source: /note="Description of Artificial Sequence: Synthetic polynucleotide"
agtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactg

SEQ ID NO: 3124 - DNA, 300 bp, Artificial Sequence
  source: /note="Description of Artificial Sequence: Synthetic polynucleotide"
ggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgt

SEQ ID NO: 3125 - DNA, 300 bp, Artificial Sequence
  source: /note="Description of Artificial Sequence: Synthetic polynucleotide"
aggtgtccagtgtgaggtgcagctggtggagtctgggggaggcttggtccagcctggggggtccctgagactctcctgtgcagcctcaggattctcctttagtagctatggcatgagctgggtccgccaggctccagggaaggggctggagtgagtggcacatatctggaatgatggaagtcagaaatactatgcagactctgtgaagggccgattcacaatctccgagacaattctaagagcatgctctatctgcaaatggacagtctgaaagctaaggacacggccatgtattactgt

SEQ ID NO: 3126 - DNA, 300 bp, Artificial Sequence
  source: /note="Description of Artificial Sequence: Synthetic polynucleotide"
cgtgaggcgcagctggtggagtctgggggaggcttggtacagcctgggtgggtccccgagactctcatttgcagcttctagattcaccttcagtgacttctgaatgcactggatccgccaggcttctgggaaagggctggagtgggttggccgtattagaaccaaacgtaacagttacacgacagaatgcgctgcatctgtgaaaggcaggttcaccatctcaagagatgattcaaagaacacactgtatctgcaagtgaataccctgaaaaccgagtacacggccatctattactgtac

SEQ ID NO: 3127 - DNA, 300 bp, Artificial Sequence
  source: /note="Description of Artificial Sequence: Synthetic polynucleotide"
aggtgtccagtgtgaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgc

SEQ ID NO: 3128 - DNA, 300 bp, Artificial Sequence
  source: /note="Description of Artificial Sequence: Synthetic polynucleotide"
gtctagtgtggggtgcagatggtggagtcttggggagagttggcacaagctgaatgtgcctgagactctgccgtgcatcctctgaatccaccttctgtagctactagatcagctgaatctgccaggctccaggaaaggggctgcagtgagtagtagatataatgtacgatggaagtcagacataatatgcagactctgtgaaggtcagattcaccatctccaaagacaatgccaagcacaggttgtatctgcaaatgaacagtctgagagctgagaatatggctctgtattattgagtca

SEQ ID NO: 3129 - DNA, 300 bp, Artificial Sequence
  source: /note="Description of Artificial Sequence: Synthetic polynucleotide"
tgtccagtgtgaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgt

SEQ ID NO: 3130 - DNA, 300 bp, Artificial Sequence
  source: /note="Description of Artificial Sequence: Synthetic polynucleotide"
tccagtgtgaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgt

SEQ ID NO: 3131 - DNA, 300 bp, Artificial Sequence
  source: /note="Description of Artificial Sequence: Synthetic polynucleotide"
aagtcctgtgtgaagtttattgatggagtcagaggcagaaaattgtacagcccagtggttcactgagactctcctgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttacaatgaccaacctgaaagccaaggacaaggctgtgtattactgt

SEQ ID NO: 3132 - DNA, 300 bp, Artificial Sequence
  source: /note="Description of Artificial Sequence: Synthetic polynucleotide"
gtccagtgtgaggtgcagctggtggagtctgggggaggcttagtaaagactgggagggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgt

SEQ ID NO: 3133 - DNA, 300 bp, Artificial Sequence
  source: /note="Description of Artificial Sequence: Synthetic polynucleotide"
tgtccagtgtgaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtactactgtgt

SEQ ID NO: 3134 - DNA, 300 bp, Artificial Sequence
  source: /note="Description of Artificial Sequence: Synthetic polynucleotide"
ttcagtgtgaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatggctgtacat

SEQ ID NO: 3135 - DNA, 300 bp, Artificial Sequence
  source: /note="Description of Artificial Sequence: Synthetic polynucleotide"
tgtgaggtgcagctggtggagtctgggggaggcttggtacagcctggggggtccctgagactctcctgtgcagcctctggattcaccttccgttaactactgcatgcagtggatctgccgggctccaggaaaggggctggagtgggtaggtttcactaaaaacaaaactaatcgtggaacaacagaatacgccgcgtctgtgaaaggcagattcaccatctcaagcgatgattccaaaagcatcgcctatctgcaaatgaacagcctgaaaaccgaggacacggccgtgtattactatac

SEQ ID NO: 3136 - DNA, 300 bp, Artificial Sequence
  source: /note="Description of Artificial Sequence: Synthetic polynucleotide"
gtgtgaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgc

SEQ ID NO: 3137 - DNA, 300 bp, Artificial Sequence
  source: /note="Description of Artificial Sequence: Synthetic polynucleotide"
cgcagttgttggagcctgggggagacttggtacagcctggcgcggtgggggtgggggtccctgagactgtcctgtgcagcctctggatttgccttcagtagccactggatgcactgggcctgccaggctccagggaacagactggagtgggtctcatgtattagtactgatgggagtagcatacgctatgcacattctgggaagttctgattccccatctccagaaacaatgccaagaacacactcttatctggaaatgaacagtttgagagctgagtacacagccacgtattactgtgc

SEQ ID NO: 3138 - DNA, 300 bp, Artificial Sequence
  source: /note="Description of Artificial Sequence: Synthetic polynucleotide"
caggtgtccaatgtgaagtgtagctggtagagtctgggggaggcttggtacagcttggggggtccatgtgactctcctgtgcagcctctggatacactttcagtaactatggcatgcactaggtggaccaagctccagggaagggactggagtgggtcttacattaatgctagtggtggaggcatatactactcagactctgtgaagggccggttgaccatctccagagaaaacaccaagaactcactgtatctgcaaataaacagtttcattgctgacaccatggccgtctattactgt

SEQ ID NO: 3139 - DNA, 300 bp, Artificial Sequence
  source: /note="Description of Artificial Sequence: Synthetic polynucleotide"
tgtccagtgtgaggtacagctggtggagtctggagaggacccaagacaacctgggttccctgagactctcctgtgcagcctctggattaaccttcagtagctactgaatgagctcggtttcccaggctccagggaaggggctggagtgagtagtagatatacagtgtgatggaagtcagatatgttatgcacaatctgtgacgagcagattcaccgtctccaaagaaaatgccaagaactcactgtatttgcaaatgaacagtctgagagcagagggcacagctgtgtgttactgtatgt

SEQ ID NO: 3140 - DNA, 300 bp, Artificial Sequence
  source: /note="Description of Artificial Sequence: Synthetic polynucleotide"
aggtgtccagtgtgaggtgcagctggtggagtctgggggaggcttggtaaagcctggggggtccctgagactctcctgtgcagcctctggattcaccttcagtgactactacatgaactgggtccgccaggctccagggaaggggctggagtgggtctcatccattagtagtagtagtaccatatactacgcagactctgtgaagggccgattcaccatctccagagacaacgccaagaactcactgtatctgcaaatgaacagcctgagagccgaggacacggctgtgtattactgtgc

SEQ ID NO: 3141 - DNA, 300 bp, Artificial Sequence
  source: /note="Description of Artificial Sequence: Synthetic polynucleotide"
ggtcctgtcccaggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgc

SEQ ID NO: 3142 - DNA, 300 bp, Artificial Sequence
  source: /note="Description of Artificial Sequence: Synthetic polynucleotide"
acaggggtcctgtcccagtgcagctgcaggagtggggcccaggactggtgaagcttcggagaccctgtccctcacatgcgctgtctctggtgactccatcagcagtggtaactggtggagctggtccgccagtccccagggaaggggctggaatggattggatacatctattatagtgggaggagctactacaccccgtccctcaggagttgagtcaccatgtcaatagaaacgtccaagaaccagttttccctgaagctgagctctgtgaccgcagggaggcggagggggcgggcgcag

SEQ ID NO: 3143 - DNA, 300 bp, Artificial Sequence
  source: /note="Description of Artificial Sequence: Synthetic polynucleotide"
agctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtattattgtgtgagagggaccatctaaa

SEQ ID NO: 3144 - DNA, 300 bp, Artificial Sequence
  source: /note="Description of Artificial Sequence: Synthetic polynucleotide"
ctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgc

SEQ ID NO: 3145 - DNA, 300 bp, Artificial Sequence
  source: /note="Description of Artificial Sequence: Synthetic polynucleotide"
aggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgc

SEQ ID NO: 3146 - DNA, 253 bp, Artificial Sequence
  source: /note="Description of Artificial Sequence: Synthetic polynucleotide"
tgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgaagatcagcagcctaaaggctgaggacacggccgtgtatgactgtatgagaga

SEQ ID NO: 3147 - DNA, 300 bp, Artificial Sequence
  source: /note="Description of Artificial Sequence: Synthetic polynucleotide"
ggtgcccactcccgagtgcagctggtgcagtctgggcctgaggtgaagcagcctggggcctcggcgaaggtctcctgcaaggtgtctggttaaactgtcatcacctatggtatgaattggatacgacagaccccaggacaggggcttgagtggatgggatggatcatcctaccctggtgaacccaatgtatgcccacagattcacacacggtttgtcttctccatggacacctctgtcagcacggcggatctgcagactagctgcctaaagactgaggatgcagccatttattactgtgt

SEQ ID NO: 3148 - DNA, 100 bp, Artificial Sequence
  source: /note="Description of Artificial Sequence: Synthetic polynucleotide"
atacttccagcactggggccagggcaccctggtcaccgtctcctcaggtgagtctgctgtctggggatagcggggagccaggtgtactgggccaggcaag

SEQ ID NO: 3149 - DNA, 100 bp, Artificial Sequence
  source: /note="Description of Artificial Sequence: Synthetic polynucleotide"
ggtacttcgatctctggggccgtggcaccctggtcactgtctcctcaggtgagtcccactgcagccccctcccagtcttctctgtccaggcaccaggcca

SEQ ID NO: 3150 - DNA, 100 bp, Artificial Sequence
  source: /note="Description of Artificial Sequence: Synthetic polynucleotide"
cttttgatatctggggccaagggacaatggtcaccgtctcttcaggtaagatggctttccttctgcctcctttctctgggcccagcgtcctctgtcctgg

SEQ ID NO: 3151 - DNA, 100 bp, Artificial Sequence
  source: /note="Description of Artificial Sequence: Synthetic polynucleotide"
tttgactactggggccagggaaccctggtcaccgtctcctcaggtgagtcctcacaacctctctcctgctttaactctgaagggttttgctgcatttctg

SEQ ID NO: 3152 - DNA, 100 bp, Artificial Sequence
  source: /note="Description of Artificial Sequence: Synthetic polynucleotide"
tggttcgacccctggggccagggaaccctggtcaccgtctcctcaggtgagtcctcaccaccccctctctgagtccacttagggagactcagcttgccag

SEQ ID NO: 3153 - DNA, 100 bp, Artificial Sequence
  source: /note="Description of Artificial Sequence: Synthetic polynucleotide"
tactactactactacatggacgtctggggcaaagggaccacggtcaccgtctcctcaggtaagaatggccactctagggcctttgttttctgctactgcc

SEQ ID NO: 3154 - DNA, 100 bp, Artificial Sequence
  source: /note="Description of Artificial Sequence: Synthetic polynucleotide"
tgctgggggcccctggacccgacccgccctggagaccgcagccacatcagcccccagccccacaggccccctaccagccgcagggttttggctgagctga

SEQ ID NO: 3155 - DNA, 100 bp, Artificial Sequence
  source: /note="Description of Artificial Sequence: Synthetic polynucleotide"
aagtgcttggagcactggggccagggcagcccggccaccgtctccctgggaacgtcacccctccctgcctgggtctcagcccgggggtctgtgtggctgg

SEQ ID NO: 3156 - DNA, 100 bp, Artificial Sequence
  source: /note="Description of Artificial Sequence: Synthetic polynucleotide"
agttggacttcccaggccgacagtggtctggcttctgaggggtcaggccagaatgtggggtacgtgggaggccagcagagggttccatgagaagggcagg

SEQ ID NO: 3157 - DNA, 495 bp, Artificial Sequence
  source: /note="Description of Artificial Sequence: Synthetic polynucleotide"
gccttgccagcccgctcagacacacgtgacactcttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgacactctgtcgacactgaagctttctttggacaaggcaccagactcacagttgtaggtaagacatttttcaggttcttttgcagatccgtcacagggaaaagtgggtccacagacacacgtgacactctctgatggcgcgagggaggc

SEQ ID NO: 3158 - DNA, 495 bp, Artificial Sequence
  source: /note="Description of Artificial Sequence: Synthetic polynucleotide"
gccttgccagcccgctcagacacacgtttcggaactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtttcggaacgtcgactatggctacaccttcggttcggggaccaggttaaccgttgtaggtaaggctgggggtctctaggaggggtgcgatgagggaggactctgtcctgggaaatacacacgtttcggaacctgatggcgcgagggaggc

SEQ ID NO: 3159 - DNA, 495 bp, Artificial Sequence
  source: /note="Description of Artificial Sequence: Synthetic polynucleotide"
gccttgccagcccgctcagacacacgtaagtaacgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaagtaacggtcgacgaaacaccatatattttggagagggaagttggctcactgttgtaggtgagtaagtcaaggctggacagctgggaacttgcaaaaaggggctggaatccagacacacgtaagtaacgctgatggcgcgagggaggc

SEQ ID NO: 3160 - DNA, 495 bp, Artificial Sequence
  source: /note="Description of Artificial Sequence: Synthetic polynucleotide"
gccttgccagcccgctcagacacacgtgtctcctatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtctcctagtcgacaatgaaaaactgttttttggcagtggaacccagctctctgtcttgggtatgtaaaagacttctttcgggatagtgtatcataaggtcggagttccaggagacacacgtgtctcctactgatggcgcgagggaggc

SEQ ID NO: 3161 - DNA, 495 bp, Artificial Sequence
  source: /note="Description of Artificial Sequence: Synthetic polynucleotide"
gccttgccagcccgctcagacacacgtagagtgtctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtagagtgtcgtcgacatcagccccagcattttggtgatgggactcgactctccatcctaggtaagttgcagaatcagggtggtatggccattgtcccttgaaggcagagttctctacacacgtagagtgtcctgatggcgcgagggaggc

SEQ ID NO: 3162 - DNA, 495 bp, Artificial Sequence
  source: /note="Description of Artificial Sequence: Synthetic polynucleotide"
gccttgccagcccgctcagacacacgtgttccgaatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgttccgaagtcgacataattcacccctccactttgggaacgggaccaggctcactgtgacaggtatgggggctccactcttgactcgggggtgcctgggtttgactgcaatgatacacacgtgttccgaactgatggcgcgagggaggc

SEQ ID NO: 3163 - DNA, 495 bp, Artificial Sequence
  source: /note="Description of Artificial Sequence: Synthetic polynucleotide"
gccttgccagcccgctcagacacacgtcgttactttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtcgttacttgtcgacacaatgagcagttcttcgggccagggacacggctcaccgtgctaggtaagaagggggctccaggtgggagagagggtgagcagcccagcctgcacgacccacacacgtcgttacttctgatggcgcgagggaggc

SEQ ID NO: 3164 - DNA, 495 bp, Artificial Sequence
  source: /note="Description of Artificial Sequence: Synthetic polynucleotide"
gccttgccagcccgctcagacacacgttaggagactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttaggagacgtcgacaccggggagctgttttttggagaaggctctaggctgaccgtactgggtaaggaggcggttggggctccggagagctccgagagggcgggatgggcagaggacacacgttaggagacctgatggcgcgagggaggc

SEQ ID NO: 3165 - DNA, 495 bp, Artificial Sequence
  source: /note="Description of Artificial Sequence: Synthetic polynucleotide"
gccttgccagcccgctcagacacacgtgtgtctactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtgtctacgtcgacagatacgcagtattttggcccaggcacccggctgacagtgctcggtaagcgggggctcccgctgaagccccggaactggggagggggcgccccgggacgcacacacgtgtgtctacctgatggcgcgagggaggc

SEQ ID NO: 3166 - DNA, 495 bp, Artificial Sequence
  source: /note="Description of Artificial Sequence: Synthetic polynucleotide"
gccttgccagcccgctcagacacacgtgtacagtgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtacagtggtcgacaaaacattcagtacttcggcgccgggacccggctctcagtgctgggtaagctggggccgccgggggaccggggacgagactgcgctcgggtttttgtgcgacacacgtgtacagtgctgatggcgcgagggaggc

SEQ ID NO: 3167 - DNA, 495 bp, Artificial Sequence
  source: /note="Description of Artificial Sequence: Synthetic polynucleotide"
gccttgccagcccgctcagacacacgtggatcatctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtggatcatcgtcgacgagacccagtacttcgggccaggcacgcggctcctggtgctcggtgagcgcgggctgctggggcgcgggcgcgggcggcttgggtctggtttttgcggggacacacgtggatcatcctgatggcgcgagggaggc

SEQ ID NO: 3168 - DNA, 495 bp, Artificial Sequence
  source: /note="Description of Artificial Sequence: Synthetic polynucleotide"
gccttgccagcccgctcagacacacgttattggcgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttattggcggtcgacgggccaacgtcctgactttcggggccggcagcaggctgaccgtgctgggtgagttttcgcgggaccacccgggcggcgggattcaggtggaaggcggcggacacacgttattggcgctgatggcgcgagggaggc

SEQ ID NO: 3169 - DNA, 495 bp, Artificial Sequence
  source: /note="Description of Artificial Sequence: Synthetic polynucleotide"
gccttgccagcccgctcagacacacgtaggcttgatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaggcttgagtcgacacgagcagtacttcgggccgggcaccaggctcacggtcacaggtgagattcgggcgtctccccaccttccagcccctcggtccccggagtcggagggtggacacacgtaggcttgactgatggcgcgagggaggc

SEQ ID NO: 3170 - DNA, 495 bp, Artificial Sequence
  source: /note="Description of Artificial Sequence: Synthetic polynucleotide"
gccttgccagcccgctcagtagacggagacactcttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagacactctgtcgacactgaagctttctttggacaaggcaccagactcacagttgtaggtaagacatttttcaggttcttttgcagatccgtcacagggaaaagtgggtccacagtagacggagacactctctgatggcgcgagggaggc

SEQ ID NO: 3171 - DNA, 495 bp, Artificial Sequence
  source: /note="Description of Artificial Sequence: Synthetic polynucleotide"
gccttgccagcccgctcagtagacggattcggaactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggattcggaacgtcgactatggctacaccttcggttcggggaccaggttaaccgttgtaggtaaggctgggggtctctaggaggggtgcgatgagggaggactctgtcctgggaaattagacggattcggaacctgatggcgcgagggaggc

SEQ ID NO: 3172 - DNA, 495 bp, Artificial Sequence
  source: /note="Description of Artificial Sequence: Synthetic polynucleotide"
gccttgccagcccgctcagtagacggaaagtaacgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaagtaacggtcgacgaaacaccatatattttggagagggaagttggctcactgttgtaggtgagtaagtcaaggctggacagctgggaacttgcaaaaaggggctggaatccagtagacggaaagtaacgctgatggcgcgagggaggc

SEQ ID NO: 3173 - DNA, 495 bp, Artificial Sequence
  source: /note="Description of Artificial Sequence: Synthetic polynucleotide"
gccttgccagcccgctcagtagacggagtctcctatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtctcctagtcgacaatgaaaaactgttttttggcagtggaacccagctctctgtcttgggtatgtaaaagacttctttcgggatagtgtatcataaggtcggagttccaggagtagacggagtctcctactgatggcgcgagggaggc

SEQ ID NO: 3174 - DNA, 495 bp, Artificial Sequence
  source: /note="Description of Artificial Sequence: Synthetic polynucleotide"
gccttgccagcccgctcagtagacggaagagtgtctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaagagtgtcgtcgacatcagccccagcattttggtgatgggactcgactctccatcctaggtaagttgcagaatcagggtggtatggccattgtcccttgaaggcagagttctcttagacggaagagtgtcctgatggcgcgagggaggc

SEQ ID NO: 3175 - DNA, 495 bp, Artificial Sequence
  source: /note="Description of Artificial Sequence: Synthetic polynucleotide"
gccttgccagcccgctcagtagacggagttccgaatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagttccgaagtcgacataattcacccctccactttgggaacgggaccaggctcactgtgacaggtatgggggctccactcttgactcgggggtgcctgggtttgactgcaatgattagacggagttccgaactgatggcgcgagggaggc

SEQ ID NO: 3176 - DNA, 495 bp, Artificial Sequence
  source: /note="Description of Artificial Sequence: Synthetic polynucleotide"
gccttgccagcccgctcagtagacggacgttactttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggacgttacttgtcgacacaatgagcagttcttcgggccagggacacggctcaccgtgctaggtaagaagggggctccaggtgggagagagggtgagcagcccagcctgcacgaccctagacggacgttacttctgatggcgcgagggaggc

SEQ ID NO: 3177 - DNA, 495 bp, Artificial Sequence
  source: /note="Description of Artificial Sequence: Synthetic polynucleotide"
gccttgccagcccgctcagtagacggataggagactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggataggagacgtcgacaccggggagctgttttttggagaaggctctaggctgaccgtactgggtaaggaggcggttggggctccggagagctccgagagggcgggatgggcagaggtagacggataggagacctgatggcgcgagggaggc

SEQ ID NO: 3178 - DNA, 495 bp, Artificial Sequence
  source: /note="Description of Artificial Sequence: Synthetic polynucleotide"
gccttgccagcccgctcagtagacggagtgtctactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtgtctacgtcgacagatacgcagtattttggcccaggcacccggctgacagtgctcggtaagcgggggctcccgctgaagccccggaactggggagggggcgccccgggacgctagacggagtgtctacctgatggcgcgagggaggc

SEQ ID NO: 3179 - DNA, 495 bp, Artificial Sequence
  source: /note="Description of Artificial Sequence: Synthetic polynucleotide"
gccttgccagcccgctcagtagacggagtacagtgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtacagtggtcgacaaaacattcagtacttcggcgccgggacccggctctcagtgctgggtaagctggggccgccgggggaccggggacgagactgcgctcgggtttttgtgcgtagacggagtacagtgctgatggcgcgagggaggc

SEQ ID NO: 3180 - DNA, 495 bp, Artificial Sequence
  source: /note="Description of Artificial Sequence: Synthetic polynucleotide"
gccttgccagcccgctcagtagacggaggatcatctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaggatcatcgtcgacgagacccagtacttcgggccaggcacgcggctcctggtgctcggtgagcgcgggctgctggggcgcgggcgcgggcggcttgggtctggtttttgcggggtagacggaggatcatcctgatggcgcgagggaggc

SEQ ID NO: 3181 - DNA, 495 bp, Artificial Sequence
  source: /note="Description of Artificial Sequence: Synthetic polynucleotide"
gccttgccagcccgctcagtagacggatattggcgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggatattggcggtcgacgggccaacgtcctgactttcggggccggcagcaggctgaccgtgctgggtgagttttcgcgggaccacccgggcggcgggattcaggtggaaggcggcggtagacggatattggcgctgatggcgcgagggaggc

SEQ ID NO: 3182 - DNA, 495 bp, Artificial Sequence
  source: /note="Description of Artificial Sequence: Synthetic polynucleotide"
gccttgccagcccgctcagtagacggaaggcttgatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaggcttgagtcgacacgagcagtacttcgggccgggcaccaggctcacggtcacaggtgagattcgggcgtctccccaccttccagcccctcggtccccggagtcggagggtggtagacggaaggcttgactgatggcgcgagggaggc

SEQ ID NO: 3183 - DNA, 495 bp, Artificial Sequence
  source: /note="Description of Artificial Sequence: Synthetic polynucleotide"
gccttgccagcccgctcagcagctcttgacactctttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgacactctgtcgacactgaagctttctttggacaaggcaccagactcacagttgtaggtaagacatttttcaggttcttttgcagatccgtcacagggaaaagtgggtccacagcagctcttgacactctctgatggcgcgagggaggc

SEQ ID NO: 3184 - DNA, 495 bp, Artificial Sequence
  source: /note="Description of Artificial Sequence: Synthetic polynucleotide"
gccttgccagcccgctcagcagctcttttcggaacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttttcggaacgtcgactatggctacaccttcggttcggggaccaggttaaccgttgtaggtaaggctgggggtctctaggaggggtgcgatgagggaggactctgtcctgggaaatcagctcttttcggaacctgatggcgcgagggaggc

SEQ ID NO: 3185 - DNA, 495 bp, Artificial Sequence
  source: /note="Description of Artificial Sequence: Synthetic polynucleotide"
gccttgccagcccgctcagcagctcttaagtaacgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaagtaacggtcgacgaaacaccatatattttggagagggaagttggctcactgttgtaggtgagtaagtcaaggctggacagctgggaacttgcaaaaaggggctggaatccagcagctcttaagtaacgctgatggcgcgagggaggc

SEQ ID NO: 3186 - DNA, 495 bp, Artificial Sequence
  source: /note="Description of Artificial Sequence: Synthetic polynucleotide"
gccttgccagcccgctcagcagctcttgtctcctattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtctcctagtcgacaatgaaaaactgttttttggcagtggaacccagctctctgtcttgggtatgtaaaagacttctttcgggatagtgtatcataaggtcggagttccaggagcagctcttgtctcctactgatggcgcgagggaggc

SEQ ID NO: 3187 - DNA, 495 bp, Artificial Sequence
  source: /note="Description of Artificial Sequence: Synthetic polynucleotide"
gccttgccagcccgctcagcagctcttagagtgtcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttagagtgtcgtcgacatcagccccagcattttggtgatgggactcgactctccatcctaggtaagttgcagaatcagggtggtatggccattgtcccttgaaggcagagttctctcagctcttagagtgtcctgatggcgcgagggaggc

SEQ ID NO: 3188 - DNA, 495 bp, Artificial Sequence
  source: /note="Description of Artificial Sequence: Synthetic polynucleotide"
gccttgccagcccgctcagcagctcttgttccgaattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgttccgaagtcgacataattcacccctccactttgggaacgggaccaggctcactgtgacaggtatgggggctccactcttgactcgggggtgcctgggtttgactgcaatgatcagctcttgttccgaactgatggcgcgagggaggc

SEQ ID NO: 3189 - DNA, 495 bp, Artificial Sequence
  source: /note="Description of Artificial Sequence: Synthetic polynucleotide"
gccttgccagcccgctcagcagctcttcgttacttttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttcgttacttgtcgacacaatgagcagttcttcgggccagggacacggctcaccgtgctaggtaagaagggggctccaggtgggagagagggtgagcagcccagcctgcacgaccccagctcttcgttacttctgatggcgcgagggaggc

SEQ ID NO: 3190 - DNA, 495 bp, Artificial Sequence
  source: /note="Description of Artificial Sequence: Synthetic polynucleotide"
gccttgccagcccgctcagcagctctttaggagacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttaggagacgtcgacaccggggagctgttttttggagaaggctctaggctgaccgtactgggtaaggaggcggttggggctccggagagctccgagagggcgggatgggcagaggcagctctttaggagacctgatggcgcgagggaggc

SEQ ID NO: 3191 - DNA, 495 bp, Artificial Sequence
  source: /note="Description of Artificial Sequence: Synthetic polynucleotide"
gccttgccagcccgctcagcagctcttgtgtctacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtgtctacgtcgacagatacgcagtattttggcccaggcacccggctgacagtgctcggtaagcgggggctcccgctgaagccccggaactggggagggggcgccccgggacgccagctcttgtgtctacctgatggcgcgagggaggc

SEQ ID NO: 3192 - DNA, 495 bp, Artificial Sequence
  source: /note="Description of Artificial Sequence: Synthetic polynucleotide"
gccttgccagcccgctcagcagctcttgtacagtgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtacagtggtcgacaaaacattcagtacttcggcgccgggacccggctctcagtgctgggtaagctggggccgccgggggaccggggacgagactgcgctcgggtttttgtgcgcagctcttgtacagtgctgatggcgcgagggaggc

SEQ ID NO: 3193 - DNA, 495 bp, Artificial Sequence
  source: /note="Description of Artificial Sequence: Synthetic polynucleotide"
gccttgccagcccgctcagcagctcttggatcatcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttggatcatcgtcgacgagacccagtacttcgggccaggcacgcggctcctggtgctcggtgagcgcgggctgctggggcgcgggcgcgggcggcttgggtctggtttttgcggggcagctcttggatcatcctgatggcgcgagggaggc

SEQ ID NO: 3194 - DNA, 495 bp, Artificial Sequence
  source: /note="Description of Artificial Sequence: Synthetic polynucleotide"
gccttgccagcccgctcagcagctctttattggcgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttattggcggtcgacgggccaacgtcctgactttcggggccggcagcaggctgaccgtgctgggtgagttttcgcgggaccacccgggcggcgggattcaggtggaaggcggcggcagctctttattggcgctgatggcgcgagggaggc

SEQ ID NO: 3195 - DNA, 495 bp, Artificial Sequence
  source: /note="Description of Artificial Sequence: Synthetic polynucleotide"
gccttgccagcccgctcagcagctcttaggcttgattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaggcttgagtcgacacgagcagtacttcgggccgggcaccaggctcacggtcacaggtgagattcgggcgtctccccaccttccagcccctcggtccccggagtcggagggtggcagctcttaggcttgactgatggcgcgagggaggc

SEQ ID NO: 3196 - DNA, 495 bp, Artificial Sequence
  source: /note="Description of Artificial Sequence: Synthetic polynucleotide"
gccttgccagcccgctcaggagcgatagacactctttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagacactctgtcgacactgaagctttctttggacaaggcaccagactcacagttgtaggtaagacatttttcaggttcttttgcagatccgtcacagggaaaagtgggtccacaggagcgatagacactctctgatggcgcgagggaggc

SEQ ID NO: 3197 - DNA, 495 bp, Artificial Sequence
  source: /note="Description of Artificial Sequence: Synthetic polynucleotide"
gccttgccagcccgctcaggagcgatattcggaacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatattcggaacgtcgactatggctacaccttcggttcggggaccaggttaaccgttgtaggtaaggctgggggtctctaggaggggtgcgatgagggaggactctgtcctgggaaatgagcgatattcggaacctgatggcgcgagggaggc

SEQ ID NO: 3198 - DNA, 495 bp, Artificial Sequence
  source: /note="Description of Artificial Sequence: Synthetic polynucleotide"
gccttgccagcccgctcaggagcgataaagtaacgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaagtaacggtcgacgaaacaccatatattttggagagggaagttggctcactgttgtaggtgagtaagtcaaggctggacagctgggaacttgcaaaaaggggctggaatccaggagcgataaagtaacgctgatggcgcgagggaggc

SEQ ID NO: 3199 - DNA, 495 bp, Artificial Sequence
  source: /note="Description of Artificial Sequence: Synthetic polynucleotide"
gccttgccagcccgctcaggagcgatagtctcctattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtctcctagtcgacaatgaaaaactgttttttggcagtggaacccagctctctgtcttgggtatgtaaaagacttctttcgggatagtgtatcataaggtcggagttccaggaggagcgatagtctcctactgatggcgcgagggaggc

SEQ ID NO: 3200 - DNA, 495 bp, Artificial Sequence
  source: /note="Description of Artificial Sequence: Synthetic polynucleotide"
gccttgccagcccgctcaggagcgataagagtgtcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataagagtgtcgtcgacatcagccccagcattttggtgatgggactcgactctccatcctaggtaagttgcagaatcagggtggtatggccattgtcccttgaaggcagagttctctgagcgataagagtgtcctgatggcgcgagggaggc

SEQ ID NO: 3201 - DNA, 495 bp, Artificial Sequence
  source: /note="Description of Artificial Sequence: Synthetic polynucleotide"
gccttgccagcccgctcaggagcgatagttccgaattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagttccgaagtcgacataattcacccctccactttgggaacgggaccaggctcactgtgacaggtatgggggctccactcttgactcgggggtgcctgggtttgactgcaatgatgagcgatagttccgaactgatggcgcgagggaggc

SEQ ID NO: 3202 - DNA, 495 bp, Artificial Sequence
  source: /note="Description of Artificial Sequence: Synthetic polynucleotide"
gccttgccagcccgctcaggagcgatacgttacttttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatacgttacttgtcgacacaatgagcagttcttcgggccagggacacggctcaccgtgctaggtaagaagggggctccaggtgggagagagggtgagcagcccagcctgcacgacccgagcgatacgttacttctgatggcgcgagggaggc

SEQ ID NO: 3203 - DNA, 495 bp, Artificial Sequence
  source: /note="Description of Artificial Sequence: Synthetic polynucleotide"
gccttgccagcccgctcaggagcgatataggagacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatataggagacgtcgacaccggggagctgttttttggagaaggctctaggctgaccgtactgggtaaggaggcggttggggctccggagagctccgagagggcgggatgggcagagggagcgatataggagacctgatggcgcgagggaggc

SEQ ID NO: 3204 - DNA, 495 bp, Artificial Sequence
  source: /note="Description of Artificial Sequence: Synthetic polynucleotide"
gccttgccagcccgctcaggagcgatagtgtctacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtgtctacgtcgacagatacgcagtattttggcccaggcacccggctgacagtgctcggtaagcgggggctcccgctgaagccccggaactggggagggggcgccccgggacgcgagcgatagtgtctacctgatggcgcgagggaggc

SEQ ID NO: 3205 - DNA, 495 bp, Artificial Sequence
  source: /note="Description of Artificial Sequence: Synthetic polynucleotide"
gccttgccagcccgctcaggagcgatagtacagtgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtacagtggtcgacaaaacattcagtacttcggcgccgggacccggctctcagtgctgggtaagctggggccgccgggggaccggggacgagactgcgctcgggtttttgtgcggagcgatagtacagtgctgatggcgcgagggaggc

SEQ ID NO: 3206 - DNA, 495 bp, Artificial Sequence
  source: /note="Description of Artificial Sequence: Synthetic polynucleotide"
gccttgccagcccgctcaggagcgataggatcatcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataggatcatcgtcgacgagacccagtacttcgggccaggcacgcggctcctggtgctcggtgagcgcgggctgctggggcgcgggcgcgggcggcttgggtctggtttttgcgggggagcgataggatcatcctgatggcgcgagggaggc

SEQ ID NO: 3207 - DNA, 495 bp, Artificial Sequence
  source: /note="Description of Artificial Sequence: Synthetic polynucleotide"
gccttgccagcccgctcaggagcgatatattggcgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatatattggcggtcgacgggccaacgtcctgactttcggggccggcagcaggctgaccgtgctgggtgagttttcgcgggaccacccgggcggcgggattcaggtggaaggcggcgggagcgatatattggcgctgatggcgcgagggaggc

SEQ ID NO: 3208 - DNA, 495 bp, Artificial Sequence
  source: /note="Description of Artificial Sequence: Synthetic polynucleotide"
gccttgccagcccgctcaggagcgataaggcttgattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaggcttgagtcgacacgagcagtacttcgggccgggcaccaggctcacggtcacaggtgagattcgggcgtctccccaccttccagcccctcggtccccggagtcggagggtgggagcgataaggcttgactgatggcgcgagggaggc

SEQ ID NO: 3209 - DNA, 495 bp, Artificial Sequence
  source: /note="Description of Artificial Sequence: Synthetic polynucleotide"
gccttgccagcccgctcaggcatctgagacactcttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagacactctgtcgacactgaagctttctttggacaaggcaccagactcacagttgtaggtaagacatttttcaggttcttttgcagatccgtcacagggaaaagtgggtccacaggcatctgagacactctctgatggcgcgagggaggc

SEQ ID NO: 3210 - DNA, 495 bp, Artificial Sequence
  source: /note="Description of Artificial Sequence: Synthetic polynucleotide"
gccttgccagcccgctcaggcatctgattcggaactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgattcggaacgtcgactatggctacaccttcggttcggggaccaggttaaccgttgtaggtaaggctgggggtctctaggaggggtgcgatgagggaggactctgtcctgggaaatgcatctgattcggaacctgatggcgcgagggaggc

SEQ ID NO: 3211 - DNA, 495 bp, Artificial Sequence
  source: /note="Description of Artificial Sequence: Synthetic polynucleotide"
gccttgccagcccgctcaggcatctgaaagtaacgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaagtaacggtcgacgaaacaccatatattttggagagggaagttggctcactgttgtaggtgagtaagtcaaggctggacagctgggaacttgcaaaaaggggctggaatccaggcatctgaaagtaacgctgatggcgcgagggaggc

SEQ ID NO: 3212 - DNA, 495 bp, Artificial Sequence
  source: /note="Description of Artificial Sequence: Synthetic polynucleotide"
gccttgccagcccgctcaggcatctgagtctcctatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtctcctagtcgacaatgaaaaactgttttttggcagtggaacccagctctctgtcttgggtatgtaaaagacttctttcgggatagtgtatcataaggtcggagttccaggaggcatctgagtctcctactgatggcgcgagggaggc

SEQ ID NO: 3213 - DNA, 495 bp, Artificial Sequence
  source: /note="Description of Artificial Sequence: Synthetic polynucleotide"
gccttgccagcccgctcaggcatctgaagagtgtctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaagagtgtcgtcgacatcagccccagcattttggtgatgggactcgactctccatcctaggtaagttgcagaatcagggtggtatggccattgtcccttgaaggcagagttctctgcatctgaagagtgtcctgatggcgcgagggaggc

SEQ ID NO: 3214 - DNA, 495 bp, Artificial Sequence
  source: /note="Description of Artificial Sequence: Synthetic polynucleotide"
gccttgccagcccgctcaggcatctgagttccgaatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagttccgaagtcgacataattcacccctccactttgggaacgggaccaggctcactgtgacaggtatgggggctccactcttgactcgggggtgcctgggtttgactgcaatgatgcatctgagttccgaactgatggcgcgagggaggc

SEQ ID NO: 3215 - DNA, 495 bp, Artificial Sequence
  source: /note="Description of Artificial Sequence: Synthetic polynucleotide"
gccttgccagcccgctcaggcatctgacgttactttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgacgttacttgtcgacacaatgagcagttcttcgggccagggacacggctcaccgtgctaggtaagaagggggctccaggtgggagagagggtgagcagcccagcctgcacgacccgcatctgacgttacttctgatggcgcgagggaggc

SEQ ID NO: 3216 - DNA, 495 bp, Artificial Sequence
  source: /note="Description of Artificial Sequence: Synthetic polynucleotide"
gccttgccagcccgctcaggcatctgataggagactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgataggagacgtcgacaccggggagctgttttttggagaaggctctaggctgaccgtactgggtaaggaggcggttggggctccggagagctccgagagggcgggatgggcagagggcatctgataggagacctgatggcgcgagggaggc

SEQ ID NO: 3217 - DNA, 495 bp, Artificial Sequence
  source: /note="Description of Artificial Sequence: Synthetic polynucleotide"
gccttgccagcccgctcaggcatctgagtgtctactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtgtctacgtcgacagatacgcagtattttggcccaggcacccggctgacagtgctcggtaagcgggggctcccgctgaagccccggaactggggagggggcgccccgggacgcgcatctgagtgtctacctgatggcgcgagggaggc

SEQ ID NO: 3218 - DNA, 495 bp, Artificial Sequence
  source: /note="Description of Artificial Sequence: Synthetic polynucleotide"
gccttgccagcccgctcaggcatctgagtacagtgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtacagtggtcgacaaaacattcagtacttcggcgccgggacccggctctcagtgctgggtaagctggggccgccgggggaccggggacgagactgcgctcgggtttttgtgcggcatctgagtacagtgctgatggcgcgagggaggc

SEQ ID NO: 3219 - DNA, 495 bp, Artificial Sequence
  source: /note="Description of Artificial Sequence: Synthetic polynucleotide"
gccttgccagcccgctcaggcatctgaggatcatctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaggatcatcgtcgacgagacccagtacttcgggccaggcacgcggctcctggtgctcggtgagcgcgggctgctggggcgcgggcgcgggcggcttgggtctggtttttgcgggggcatctgaggatcatcctgatggcgcgagggaggc

SEQ ID NO: 3220 - DNA, 495 bp, Artificial Sequence
  source: /note="Description of Artificial Sequence: Synthetic polynucleotide"
gccttgccagcccgctcaggcatctgatattggcgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgatattggcggtcgacgggccaacgtcctgactttcggggccggcagcaggctgaccgtgctgggtgagttttcgcgggaccacccgggcggcgggattcaggtggaaggcggcgggcatctgatattggcgctgatggcgcgagggaggc

SEQ ID NO: 3221 - DNA, 495 bp, Artificial Sequence
  source: /note="Description of Artificial Sequence: Synthetic polynucleotide"
gccttgccagcccgctcaggcatctgaaggcttgatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaggcttgagtcgacacgagcagtacttcgggccgggcaccaggctcacggtcacaggtgagattcgggcgtctccccaccttccagcccctcggtccccggagtcggagggtgggcatctgaaggcttgactgatggcgcgagggaggc

SEQ ID NO: 3222 - DNA, 495 bp, Artificial Sequence
  source: /note="Description of Artificial Sequence: Synthetic polynucleotide"
gccttgccagcccgctcagtgctacacgacactcttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgacactctgtcgacactgaagctttctttggacaaggcaccagactcacagttgtaggtaagacatttttcaggttcttttgcagatccgtcacagggaaaagtgggtccacagtgctacacgacactctctgatggcgcgagggaggc

SEQ ID NO: 3223 - DNA, 495 bp, Artificial Sequence
  source: /note="Description of Artificial Sequence: Synthetic polynucleotide"
gccttgccagcccgctcagtgctacacttcggaactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacttcggaacgtcgactatggctacaccttcggttcggggaccaggttaaccgttgtaggtaaggctgggggtctctaggaggggtgcgatgagggaggactctgtcctgggaaattgctacacttcggaacctgatggcgcgagggaggc

SEQ ID NO: 3224 - DNA, 495 bp, Artificial Sequence
  source: /note="Description of Artificial Sequence: Synthetic polynucleotide"
gccttgccagcccgctcagtgctacacaagtaacgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaagtaacggtcgacgaaacaccatatattttggagagggaagttggctcactgttgtaggtgagtaagtcaaggctggacagctgggaacttgcaaaaaggggctggaatccagtgctacacaagtaacgctgatggcgcgagggaggc

SEQ ID NO: 3225 - DNA, 495 bp, Artificial Sequence
  source: /note="Description of Artificial Sequence: Synthetic polynucleotide"
gccttgccagcccgctcagtgctacacgtctcctatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtctcctagtcgacaatgaaaaactgttttttggcagtggaacccagctctctgtcttgggtatgtaaaagacttctttcgggatagtgtatcataaggtcggagttccaggagtgctacacgtctcctactgatggcgcgagggaggc

SEQ ID NO: 3226 - DNA, 495 bp, Artificial Sequence
  source: /note="Description of Artificial Sequence: Synthetic polynucleotide"
gccttgccagcccgctcagtgctacacagagtgtctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacagagtgtcgtcgacatcagccccagcattttggtgatgggactcgactctccatcctaggtaagttgcagaatcagggtggtatggccattgtcccttgaaggcagagttctcttgctacacagagtgtcctgatggcgcgagggaggc

SEQ ID NO: 3227 - DNA, 495 bp, Artificial Sequence
  source: /note="Description of Artificial Sequence: Synthetic polynucleotide"
gccttgccagcccgctcagtgctacacgttccgaatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgttccgaagtcgacataattcacccctccactttgggaacgggaccaggctcactgtgacaggtatgggggctccactcttgactcgggggtgcctgggtttgactgcaatgattgctacacgttccgaactgatggcgcgagggaggc

SEQ ID NO: 3228 - DNA, 495 bp, Artificial Sequence
  source: /note="Description of Artificial Sequence: Synthetic polynucleotide"
gccttgccagcccgctcagtgctacaccgttactttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacaccgttacttgtcgacacaatgagcagttcttcgggccagggacacggctcaccgtgctaggtaagaagggggctccaggtgggagagagggtgagcagcccagcctgcacgaccctgctacaccgttacttctgatggcgcgagggaggc

SEQ ID NO: 3229 - DNA, 495 bp, Artificial Sequence
  source: /note="Description of Artificial Sequence: Synthetic polynucleotide"
gccttgccagcccgctcagtgctacactaggagactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactaggagacgtcgacaccggggagctgttttttggagaaggctctaggctgaccgtactgggtaaggaggcggttggggctccggagagctccgagagggcgggatgggcagaggtgctacactaggagacctgatggcgcgagggaggc

SEQ ID NO: 3230 - DNA, 495 bp, Artificial Sequence
  source: /note="Description of Artificial Sequence: Synthetic polynucleotide"
gccttgccagcccgctcagtgctacacgtgtctactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtgtctacgtcgacagatacgcagtattttggcccaggcacccggctgacagtgctcggtaagcgggggctcccgctgaagccccggaactggggagggggcgccccgggacgctgctacacgtgtctacctgatggcgcgagggaggc

SEQ ID NO: 3231 - DNA, 495 bp, Artificial Sequence
  source: /note="Description of Artificial Sequence: Synthetic polynucleotide"
gccttgccagcccgctcagtgctacacgtacagtgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtacagtggtcgacaaaacattcagtacttcggcgccgggacccggctctcagtgctgggtaagctggggccgccgggggaccggggacgagactgcgctcgggtttttgtgcgtgctacacgtacagtgctgatggcgcgagggaggc

SEQ ID NO: 3232 - DNA, 495 bp, Artificial Sequence
  source: /note="Description of Artificial Sequence: Synthetic polynucleotide"
gccttgccagcccgctcagtgctacacggatcatctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacggatcatcgtcgacgagacccagtacttcgggccaggcacgcggctcctggtgctcggtgagcgcgggctgctggggcgcgggcgcgggcggcttgggtctggtttttgcggggtgctacacggatcatcctgatggcgcgagggaggc

SEQ ID NO: 3233 - DNA, 495 bp, Artificial Sequence
  source: /note="Description of Artificial Sequence: Synthetic polynucleotide"
gccttgccagcccgctcagtgctacactattggcgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactattggcggtcgacgggccaacgtcctgactttcggggccggcagcaggctgaccgtgctgggtgagttttcgcgggaccacccgggcggcgggattcaggtggaaggcggcggtgctacactattggcgctgatggcgcgagggaggc

SEQ ID NO: 3234 - DNA, 495 bp, Artificial Sequence
  source: /note="Description of Artificial Sequence: Synthetic polynucleotide"
gccttgccagcccgctcagtgctacacaggcttgatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaggcttgagtcgacacgagcagtacttcgggccgggcaccaggctcacggtcacaggtgagattcgggcgtctccccaccttccagcccctcggtccccggagtcggagggtggtgctacacaggcttgactgatggcgcgagggaggc

SEQ ID NO: 3235 - DNA, 495 bp, Artificial Sequence
  source: /note="Description of Artificial Sequence: Synthetic polynucleotide"
gccttgccagcccgctcagaactgccagacactcttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagacactctgtcgacactgaagctttctttggacaaggcaccagactcacagttgtaggtaagacatttttcaggttcttttgcagatccgtcacagggaaaagtgggtccacagaactgccagacactctctgatggcgcgagggaggc

SEQ ID NO: 3236 - DNA, 495 bp, Artificial Sequence
  source: /note="Description of Artificial Sequence: Synthetic polynucleotide"
gccttgccagcccgctcagaactgccattcggaactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccattcggaacgtcgactatggctacaccttcggttcggggaccaggttaaccgttgtaggtaaggctgggggtctctaggaggggtgcgatgagggaggactctgtcctgggaaataactgccattcggaacctgatggcgcgagggaggc

SEQ ID NO: 3237 - DNA, 495 bp, Artificial Sequence
  source: /note="Description of Artificial Sequence: Synthetic polynucleotide"
gccttgccagcccgctcagaactgccaaagtaacgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaagtaacggtcgacgaaacaccatatattttggagagggaagttggctcactgttgtaggtgagtaagtcaaggctggacagctgggaacttgcaaaaaggggctggaatccagaactgccaaagtaacgctgatggcgcgagggaggc

SEQ ID NO: 3238 - DNA, 495 bp, Artificial Sequence
  source: /note="Description of Artificial Sequence: Synthetic polynucleotide"
gccttgccagcccgctcagaactgccagtctcctatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtctcctagtcgacaatgaaaaactgttttttggcagtggaacccagctctctgtcttgggtatgtaaaagacttctttcgggatagtgtatcataaggtcggagttccaggagaactgccagtctcctactgatggcgcgagggaggc

SEQ ID NO: 3239 - DNA, 495 bp, Artificial Sequence
  source: /note="Description of Artificial Sequence: Synthetic polynucleotide"
gccttgccagcccgctcagaactgccaagagtgtctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaagagtgtcgtcgacatcagccccagcattttggtgatgggactcgactctccatcctaggtaagttgcagaatcagggtggtatggccattgtcccttgaaggcagagttctctaactgccaagagtgtcctgatggcgcgagggaggc

SEQ ID NO: 3240 - DNA, 495 bp, Artificial Sequence
  source: /note="Description of Artificial Sequence: Synthetic polynucleotide"
gccttgccagcccgctcagaactgccagttccgaatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagttccgaagtcgacataattcacccctccactttgggaacgggaccaggctcactgtgacaggtatgggggctccactcttgactcgggggtgcctgggtttgactgcaatgataactgccagttccgaactgatggcgcgagggaggc

SEQ ID NO: 3241 - DNA, 495 bp, Artificial Sequence
  source: /note="Description of Artificial Sequence: Synthetic polynucleotide"
gccttgccagcccgctcagaactgccacgttactttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccacgttacttgtcgacacaatgagcagttcttcgggccagggacacggctcaccgtgctaggtaagaagggggctccaggtgggagagagggtgagcagcccagcctgcacgacccaactgccacgttacttctgatggcgcgagggaggc

SEQ ID NO: 3242 - DNA, 495 bp, Artificial Sequence
  source: /note="Description of Artificial Sequence: Synthetic polynucleotide"
gccttgccagcccgctcagaactgccataggagactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccataggagacgtcgacaccggggagctgttttttggagaaggctctaggctgaccgtactgggtaaggaggcggttggggctccggagagctccgagagggcgggatgggcagaggaactgccataggagacctgatggcgcgagggaggc

SEQ ID NO: 3243 - DNA, 495 bp, Artificial Sequence
  source: /note="Description of Artificial Sequence: Synthetic polynucleotide"
gccttgccagcccgctcagaactgccagtgtctactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtgtctacgtcgacagatacgcagtattttggcccaggcacccggctgacagtgctcggtaagcgggggctcccgctgaagccccggaactggggagggggcgccccgggacgcaactgccagtgtctacctgatggcgcgagggaggc

SEQ ID NO: 3244 - DNA, 495 bp, Artificial Sequence
  source: /note="Description of Artificial Sequence: Synthetic polynucleotide"
gccttgccagcccgctcagaactgccagtacagtgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtacagtggtcgacaaaacattcagtacttcggcgccgggacccggctctcagtgctgggtaagctggggccgccgggggaccggggacgagactgcgctcgggtttttgtgcgaactgccagtacagtgctgatggcgcgagggaggc

SEQ ID NO: 3245 - DNA, 495 bp, Artificial Sequence
  source: /note="Description of Artificial Sequence: Synthetic polynucleotide"
gccttgccagcccgctcagaactgccaggatcatctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaggatcatcgtcgacgagacccagtacttcgggccaggcacgcggctcctggtgctcggtgagcgcgggctgctggggcgcgggcgcgggcggcttgggtctggtttttgcggggaactgccaggatcatcctgatggcgcgagggaggc

SEQ ID NO: 3246 - DNA, 495 bp, Artificial Sequence
  source: /note="Description of Artificial Sequence: Synthetic polynucleotide"
gccttgccagcccgctcagaactgccatattggcgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccatattggcggtcgacgggccaacgtcctgactttcggggccggcagcaggctgaccgtgctgggtgagttttcgcgggaccacccgggcggcgggattcaggtggaaggcggcggaactgccatattggcgctgatggcgcgagggaggc

SEQ ID NO: 3247 - DNA, 495 bp, Artificial Sequence
  source: /note="Description of Artificial Sequence: Synthetic polynucleotide"
gccttgccagcccgctcagaactgccaaggcttgatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaggcttgagtcgacacgagcagtacttcgggccgggcaccaggctcacggtcacaggtgagattcgggcgtctccccaccttccagcccctcggtccccggagtcggagggtggaactgccaaggcttgactgatggcgcgagggaggc

SEQ ID NO: 3248 - DNA, 495 bp, Artificial Sequence
  source: /note="Description of Artificial Sequence: Synthetic polynucleotide"
gccttgccagcccgctcagttggactggacactctcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggacactctgtcgacactgaagctttctttggacaaggcaccagactcacagttgtaggtaagacatttttcaggttcttttgcagatccgtcacagggaaaagtgggtccacagttggactggacactctctgatggcgcgagggaggc

SEQ ID NO: 3249 - DNA, 495 bp, Artificial Sequence
  source: /note="Description of Artificial Sequence: Synthetic polynucleotide"
gccttgccagcccgctcagttggactgttcggaaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgttcggaacgtcgactatggctacaccttcggttcggggaccaggttaaccgttgtaggtaaggctgggggtctctaggaggggtgcgatgagggaggactctgtcctgggaaatttggactgttcggaacctgatggcgcgagggaggc

SEQ ID NO: 3250 - DNA, 495 bp, Artificial Sequence
  source: /note="Description of Artificial Sequence: Synthetic polynucleotide"
gccttgccagcccgctcagttggactgaagtaacgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaagtaacggtcgacgaaacaccatatattttggagagggaagttggctcactgttgtaggtgagtaagtcaaggctggacagctgggaacttgcaaaaaggggctggaatccagttggactgaagtaacgctgatggcgcgagggaggc

SEQ ID NO: 3251 - DNA, 495 bp, Artificial Sequence
  source: /note="Description of Artificial Sequence: Synthetic polynucleotide"
gccttgccagcccgctcagttggactggtctcctacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtctcctagtcgacaatgaaaaactgttttttggcagtggaacccagctctctgtcttgggtatgtaaaagacttctttcgggatagtgtatcataaggtcggagttccaggagttggactggtctcctactgatggcgcgagggaggc

SEQ ID NO: 3252 - DNA, 495 bp, Artificial Sequence
  source: /note="Description of Artificial Sequence: Synthetic polynucleotide"
gccttgccagcccgctcagttggactgagagtgtccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgagagtgtcgtcgacatcagccccagcattttggtgatgggactcgactctccatcctaggtaagttgcagaatcagggtggtatggccattgtcccttgaaggcagagttctctttggactgagagtgtcctgatggcgcgagggaggc

SEQ ID NO: 3253 - DNA, 495 bp, Artificial Sequence
  source: /note="Description of Artificial Sequence: Synthetic polynucleotide"
gccttgccagcccgctcagttggactggttccgaacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggttccgaagtcgacataattcacccctccactttgggaacgggaccaggctcactgtgacaggtatgggggctccactcttgactcgggggtgcctgggtttgactgcaatgatttggactggttccgaactgatggcgcgagggaggc

SEQ ID NO: 3254 - DNA, 495 bp, Artificial Sequence
  source: /note="Description of Artificial Sequence: Synthetic polynucleotide"
gccttgccagcccgctcagttggactgcgttacttcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgcgttacttgtcgacacaatgagcagttcttcgggccagggacacggctcaccgtgctaggtaagaagggggctccaggtgggagagagggtgagcagcccagcctgcacgacccttggactgcgttacttctgatggcgcgagggaggc

SEQ ID NO: 3255 - DNA, 495 bp, Artificial Sequence
  source: /note="Description of Artificial Sequence: Synthetic polynucleotide"
gccttgccagcccgctcagttggactgtaggagaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtaggagacgtcgacaccggggagctgttttttggagaaggctctaggctgaccgtactgggtaaggaggcggttggggctccggagagctccgagagggcgggatgggcagaggttggactgtaggagacctgatggcgcgagggaggc

SEQ ID NO: 3256 - DNA, 495 bp, Artificial Sequence
  source: /note="Description of Artificial Sequence: Synthetic polynucleotide"
gccttgccagcccgctcagttggactggtgtctaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtgtctacgtcgacagatacgcagtattttggcccaggcacccggctgacagtgctcggtaagcgggggctcccgctgaagccccggaactggggagggggcgccccgggacgcttggactggtgtctacctgatggcgcgagggaggc

SEQ ID NO: 3257 - DNA, 495 bp, Artificial Sequence
  source: /note="Description of Artificial Sequence: Synthetic polynucleotide"
gccttgccagcccgctcagttggactggtacagtgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtacagtggtcgacaaaacattcagtacttcggcgccgggacccggctctcagtgctgggtaagctggggccgccgggggaccggggacgagactgcgctcgggtttttgtgcgttggactggtacagtgctgatggcgcgagggaggc

SEQ ID NO: 3258 - DNA, 495 bp, Artificial Sequence
  source: /note="Description of Artificial Sequence: Synthetic polynucleotide"
gccttgccagcccgctcagttggactgggatcatccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgggatcatcgtcgacgagacccagtacttcgggccaggcacgcggctcctggtgctcggtgagcgcgggctgctggggcgcgggcgcgggcggcttgggtctggtttttgcggggttggactgggatcatcctgatggcgcgagggaggc

SEQ ID NO: 3259 - DNA, 495 bp, Artificial Sequence
  source: /note="Description of Artificial Sequence: Synthetic polynucleotide"
gccttgccagcccgctcagttggactgtattggcgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtattggcggtcgacgggccaacgtcctgactttcggggccggcagcaggctgaccgtgctgggtgagttttcgcgggaccacccgggcggcgggattcaggtggaaggcggcggttggactgtattggcgctgatggcgcgagggaggc

SEQ ID NO: 3260 - DNA, 495 bp, Artificial Sequence
  source: /note="Description of Artificial Sequence: Synthetic polynucleotide"
gccttgccagcccgctcagttggactgaggcttgacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaggcttgagtcgacacgagcagtacttcgggccgggcaccaggctcacggtcacaggtgagattcgggcgtctccccaccttccagcccctcggtccccggagtcggagggtggttggactgaggcttgactgatggcgcgagggaggc

SEQ ID NO: 3261 - DNA, 495 bp, Artificial Sequence
  source: /note="Description of Artificial Sequence: Synthetic polynucleotide"
gccttgccagcccgctcaggtagacacgacactctttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgacactctgtcgacactgaagctttctttggacaaggcaccagactcacagttgtaggtaagacatttttcaggttcttttgcagatccgtcacagggaaaagtgggtccacaggtagacacgacactctctgatggcgcgagggaggc

SEQ ID NO: 3262 - DNA, 495 bp, Artificial Sequence
  source: /note="Description of Artificial Sequence: Synthetic polynucleotide"
gccttgccagcccgctcaggtagacacttcggaacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacttcggaacgtcgactatggctacaccttcggttcggggaccaggttaaccgttgtaggtaaggctgggggtctctaggaggggtgcgatgagggaggactctgtcctgggaaatgtagacacttcggaacctgatggcgcgagggaggc

SEQ ID NO: 3263 - DNA, 495 bp, Artificial Sequence
  source: /note="Description of Artificial Sequence: Synthetic polynucleotide"
gccttgccagcccgctcaggtagacacaagtaacgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaagtaacggtcgacgaaacaccatatattttggagagggaagttggctcactgttgtaggtgagtaagtcaaggctggacagctgggaacttgcaaaaaggggctggaatccaggtagacacaagtaacgctgatggcgcgagggaggc

SEQ ID NO: 3264 - DNA, 495 bp, Artificial Sequence
  source: /note="Description of Artificial Sequence: Synthetic polynucleotide"
gccttgccagcccgctcaggtagacacgtctcctattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtctcctagtcgacaatgaaaaactgttttttggcagtggaacccagctctctgtcttgggtatgtaaaagacttctttcgggatagtgtatcataaggtcggagttccaggaggtagacacgtctcctactgatggcgcgagggaggc

SEQ ID NO: 3265 - DNA, 495 bp, Artificial Sequence
  source: /note="Description of Artificial Sequence: Synthetic polynucleotide"
gccttgccagcccgctcaggtagacacagagtgtcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacagagtgtcgtcgacatcagccccagcattttggtgatgggactcgactctccatcctaggtaagttgcagaatcagggtggtatggccattgtcccttgaaggcagagttctctgtagacacagagtgtcctgatggcgcgagggaggc

SEQ ID NO: 3266 - DNA, 495 bp, Artificial Sequence
  source: /note="Description of Artificial Sequence: Synthetic polynucleotide"
gccttgccagcccgctcaggtagacacgttccgaattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgttccgaagtcgacataattcacccctccactttgggaacgggaccaggctcactgtgacaggtatgggggctccactcttgactcgggggtgcctgggtttgactgcaatgatgtagacacgttccgaactgatggcgcgagggaggc

SEQ ID NO: 3267 - DNA, 495 bp, Artificial Sequence
  source: /note="Description of Artificial Sequence: Synthetic polynucleotide"
gccttgccagcccgctcaggtagacaccgttacttttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacaccgttacttgtcgacacaatgagcagttcttcgggccagggacacggctcaccgtgctaggtaagaagggggctccaggtgggagagagggtgagcagcccagcctgcacgacccgtagacaccgttacttctgatggcgcgagggaggc

SEQ ID NO: 3268 - DNA, 495 bp, Artificial Sequence
  source: /note="Description of Artificial Sequence: Synthetic polynucleotide"
gccttgccagcccgctcaggtagacactaggagacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactaggagacgtcgacaccggggagctgttttttggagaaggctctaggctgaccgtactgggtaaggaggcggttggggctccggagagctccgagagggcgggatgggcagagggtagacactaggagacctgatggcgcgagggaggc

SEQ ID NO: 3269 - DNA, 495 bp, Artificial Sequence
  source: /note="Description of Artificial Sequence: Synthetic polynucleotide"
gccttgccagcccgctcaggtagacacgtgtctacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtgtctacgtcgacagatacgcagtattttggcccaggcacccggctgacagtgctcggtaagcgggggctcccgctgaagccccggaactggggagggggcgccccgggacgcgtagacacgtgtctacctgatggcgcgagggaggc

SEQ ID NO: 3270 - DNA, 495 bp, Artificial Sequence
  source: /note="Description of Artificial Sequence: Synthetic polynucleotide"
gccttgccagcccgctcaggtagacacgtacagtgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtacagtggtcgacaaaacattcagtacttcggcgccgggacccggctctcagtgctgggtaagctggggccgccgggggaccggggacgagactgcgctcgggtttttgtgcggtagacacgtacagtgctgatggcgcgagggaggc

SEQ ID NO: 3271 - DNA, 495 bp, Artificial Sequence
  source: /note="Description of Artificial Sequence: Synthetic polynucleotide"
gccttgccagcccgctcaggtagacacggatcatcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacggatcatcgtcgacgagacccagtacttcgggccaggcacgcggctcctggtgctcggtgagcgcgggctgctggggcgcgggcgcgggcggcttgggtctggtttttgcgggggtagacacggatcatcctgatggcgcgagggaggc

SEQ ID NO: 3272 - DNA, 495 bp, Artificial Sequence
  source: /note="Description of Artificial Sequence: Synthetic polynucleotide"
gccttgccagcccgctcaggtagacactattggcgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactattggcggtcgacgggccaacgtcctgactttcggggccggcagcaggctgaccgtgctgggtgagttttcgcgggaccacccgggcggcgggattcaggtggaaggcggcgggtagacactattggcgctgatggcgcgagggaggc

SEQ ID NO: 3273 - DNA, 495 bp, Artificial Sequence
  source: /note="Description of Artificial Sequence: Synthetic polynucleotide"
gccttgccagcccgctcaggtagacacaggcttgattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaggcttgagtcgacacgagcagtacttcgggccgggcaccaggctcacggtcacaggtgagattcgggcgtctccccaccttccagcccctcggtccccggagtcggagggtgggtagacacaggcttgactgatggcgcgagggaggc

SEQ ID NO: 3274 - DNA, 495 bp, Artificial Sequence
  source: /note="Description of Artificial Sequence: Synthetic polynucleotide"
gccttgccagcccgctcagcactgtacgacactctcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgacactctgtcgacactgaagctttctttggacaaggcaccagactcacagttgtaggtaagacatttttcaggttcttttgcagatccgtcacagggaaaagtgggtccacagcactgtacgacactctctgatggcgcgagggaggc

SEQ ID NO: 3275 - DNA, 495 bp, Artificial Sequence
  source: /note="Description of Artificial Sequence: Synthetic polynucleotide"
gccttgccagcccgctcagcactgtacttcggaaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacttcggaacgtcgactatggctacaccttcggttcggggaccaggttaaccgttgtaggtaaggctgggggtctctaggaggggtgcgatgagggaggactctgtcctgggaaatcactgtacttcggaacctgatggcgcgagggaggc

SEQ ID NO: 3276 - DNA, 495 bp, Artificial Sequence
  source: /note="Description of Artificial Sequence: Synthetic polynucleotide"
gccttgccagcccgctcagcactgtacaagtaacgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaagtaacggtcgacgaaacaccatatattttggagagggaagttggctcactgttgtaggtgagtaagtcaaggctggacagctgggaacttgcaaaaaggggctggaatccagcactgtacaagtaacgctgatggcgcgagggaggc

SEQ ID NO: 3277 - DNA, 495 bp, Artificial Sequence
  source: /note="Description of Artificial Sequence: Synthetic polynucleotide"
gccttgccagcccgctcagcactgtacgtctcctacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtctcctagtcgacaatgaaaaactgttttttggcagtggaacccagctctctgtcttgggtatgtaaaagacttctttcgggatagtgtatcataaggtcggagttccaggagcactgtacgtctcctactgatggcgcgagggaggc

SEQ ID NO: 3278 - DNA, 495 bp, Artificial Sequence
  source: /note="Description of Artificial Sequence: Synthetic polynucleotide"
gccttgccagcccgctcagcactgtacagagtgtccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacagagtgtcgtcgacatcagccccagcattttggtgatgggactcgactctccatcctaggtaagttgcagaatcagggtggtatggccattgtcccttgaaggcagagttctctcactgtacagagtgtcctgatggcgcgagggaggc

SEQ ID NO: 3279 - DNA, 495 bp, Artificial Sequence
  source: /note="Description of Artificial Sequence: Synthetic polynucleotide"
gccttgccagcccgctcagcactgtacgttccgaacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgttccgaagtcgacataattcacccctccactttgggaacgggaccaggctcactgtgacaggtatgggggctccactcttgactcgggggtgcctgggtttgactgcaatgatcactgtacgttccgaactgatggcgcgagggaggc

SEQ ID NO: 3280 - DNA, 495 bp, Artificial Sequence
  source: /note="Description of Artificial Sequence: Synthetic polynucleotide"
gccttgccagcccgctcagcactgtaccgttacttcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtaccgttacttgtcgacacaatgagcagttcttcgggccagggacacggctcaccgtgctaggtaagaagggggctccaggtgggagagagggtgagcagcccagcctgcacgaccccactgtaccgttacttctgatggcgcgagggaggc

SEQ ID NO: 3281 - DNA, 495 bp, Artificial Sequence
  source: /note="Description of Artificial Sequence: Synthetic polynucleotide"
gccttgccagcccgctcagcactgtactaggagaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactaggagacgtcgacaccggggagctgttttttggagaaggctctaggctgaccgtactgggtaaggaggcggttggggctccggagagctccgagagggcgggatgggcagaggcactgtactaggagacctgatggcgcgagggaggc

SEQ ID NO: 3282 - DNA, 495 bp, Artificial Sequence
  source: /note="Description of Artificial Sequence: Synthetic polynucleotide"
gccttgccagcccgctcagcactgtacgtgtctaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtgtctacgtcgacagatacgcagtattttggcccaggcacccggctgacagtgctcggtaagcgggggctcccgctgaagccccggaactggggagggggcgccccgggacgccactgtacgtgtctacctgatggcgcgagggaggc

SEQ ID NO: 3283 - DNA, 495 bp, Artificial Sequence
  source: /note="Description of Artificial Sequence: Synthetic polynucleotide"
gccttgccagcccgctcagcactgtacgtacagtgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtacagtggtcgacaaaacattcagtacttcggcgccgggacccggctctcagtgctgggtaagctggggccgccgggggaccggggacgagactgcgctcgggtttttgtgcgcactgtacgtacagtgctgatggcgcgagggaggc

SEQ ID NO: 3284 - DNA, 495 bp, Artificial Sequence
  source: /note="Description of Artificial Sequence: Synthetic polynucleotide"
gccttgccagcccgctcagcactgtacggatcatccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacggatcatcgtcgacgagacccagtacttcgggccaggcacgcggctcctggtgctcggtgagcgcgggctgctggggcgcgggcgcgggcggcttgggtctggtttttgcggggcactgtacggatcatcctgatggcgcgagggaggc

SEQ ID NO: 3285 - DNA, 495 bp, Artificial Sequence
  source: /note="Description of Artificial Sequence: Synthetic polynucleotide"
gccttgccagcccgctcagcactgtactattggcgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactattggcggtcgacgggccaacgtcctgactttcggggccggcagcaggctgaccgtgctgggtgagttttcgcgggaccacccgggcggcgggattcaggtggaaggcggcggcactgtactattggcgctgatggcgcgagggaggc

SEQ ID NO: 3286 - DNA, 495 bp, Artificial Sequence
  source: /note="Description of Artificial Sequence: Synthetic polynucleotide"
gccttgccagcccgctcagcactgtacaggcttgacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaggcttgagtcgacacgagcagtacttcgggccgggcaccaggctcacggtcacaggtgagattcgggcgtctccccaccttccagcccctcggtccccggagtcggagggtggcactgtacaggcttgactgatggcgcgagggaggc

SEQ ID NO: 3287 - DNA, 495 bp, Artificial Sequence
  source: /note="Description of Artificial Sequence: Synthetic polynucleotide"
gccttgccagcccgctcaggatgatccgacactctcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgacactctgtcgacactgaagctttctttggacaaggcaccagactcacagttgtaggtaagacatttttcaggttcttttgcagatccgtcacagggaaaagtgggtccacaggatgatccgacactctctgatggcgcgagggaggc

SEQ ID NO: 3288 - DNA, 495 bp, Artificial Sequence
  source: /note="Description of Artificial Sequence: Synthetic polynucleotide"
gccttgccagcccgctcaggatgatccttcggaaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccttcggaacgtcgactatggctacaccttcggttcggggaccaggttaaccgttgtaggtaaggctgggggtctctaggaggggtgcgatgagggaggactctgtcctgggaaatgatgatccttcggaacctgatggcgcgagggaggc

SEQ ID NO: 3289 - DNA, 495 bp, Artificial Sequence
  source: /note="Description of Artificial Sequence: Synthetic polynucleotide"
gccttgccagcccgctcaggatgatccaagtaacgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaagtaacggtcgacgaaacaccatatattttggagagggaagttggctcactgttgtaggtgagtaagtcaaggctggacagctgggaacttgcaaaaaggggctggaatccaggatgatccaagtaacgctgatggcgcgagggaggc

SEQ ID NO: 3290 - DNA, 495 bp, Artificial Sequence
  source: /note="Description of Artificial Sequence: Synthetic polynucleotide"
gccttgccagcccgctcaggatgatccgtctcctacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtctcctagtcgacaatgaaaaactgttttttggcagtggaacccagctctctgtcttgggtatgtaaaagacttctttcgggatagtgtatcataaggtcggagttccaggaggatgatccgtctcctactgatggcgcgagggaggc

SEQ ID NO: 3291 - DNA, 495 bp, Artificial Sequence
  source: /note="Description of Artificial Sequence: Synthetic polynucleotide"
gccttgccagcccgctcaggatgatccagagtgtccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccagagtgtcgtcgacatcagccccagcattttggtgatgggactcgactctccatcctaggtaagttgcagaatcagggtggtatggccattgtcccttgaaggcagagttctctgatgatccagagtgtcctgatggcgcgagggaggc

SEQ ID NO: 3292 - DNA, 495 bp, Artificial Sequence
  source: /note="Description of Artificial Sequence: Synthetic polynucleotide"
gccttgccagcccgctcaggatgatccgttccgaacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgttccgaagtcgacataattcacccctccactttgggaacgggaccaggctcactgtgacaggtatgggggctccactcttgactcgggggtgcctgggtttgactgcaatgatgatgatccgttccgaactgatggcgcgagggaggc

SEQ ID NO: 3293 - DNA, 495 bp, Artificial Sequence
  source: /note="Description of Artificial Sequence: Synthetic polynucleotide"
gccttgccagcccgctcaggatgatcccgttacttcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcccgttacttgtcgacacaatgagcagttcttcgggccagggacacggctcaccgtgctaggtaagaagggggctccaggtgggagagagggtgagcagcccagcctgcacgacccgatgatcccgttacttctgatggcgcgagggaggc

SEQ ID NO: 3294 - DNA, 495 bp, Artificial Sequence
  source: /note="Description of Artificial Sequence: Synthetic polynucleotide"
gccttgccagcccgctcaggatgatcctaggagaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctaggagacgtcgacaccggggagctgttttttggagaaggctctaggctgaccgtactgggtaaggaggcggttggggctccggagagctccgagagggcgggatgggcagagggatgatcctaggagacctgatggcgcgagggaggc

SEQ ID NO: 3295 - DNA, 495 bp, Artificial Sequence
  source: /note="Description of Artificial Sequence: Synthetic polynucleotide"
gccttgccagcccgctcaggatgatccgtgtctaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtgtctacgtcgacagatacgcagtattttggcccaggcacccggctgacagtgctcggtaagcgggggctcccgctgaagccccggaactggggagggggcgccccgggacgcgatgatccgtgtctacctgatggcgcgagggaggc

SEQ ID NO: 3296 - DNA, 495 bp, Artificial Sequence
  source: /note="Description of Artificial Sequence: Synthetic polynucleotide"
gccttgccagcccgctcaggatgatccgtacagtgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtacagtggtcgacaaaacattcagtacttcggcgccgggacccggctctcagtgctgggtaagctggggccgccgggggaccggggacgagactgcgctcgggtttttgtgcggatgatccgtacagtgctgatggcgcgagggaggc

SEQ ID NO: 3297 - DNA, 495 bp, Artificial Sequence
  source: /note="Description of Artificial Sequence: Synthetic polynucleotide"
gccttgccagcccgctcaggatgatccggatcatccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccggatcatcgtcgacgagacccagtacttcgggccaggcacgcggctcctggtgctcggtgagcgcgggctgctggggcgcgggcgcgggcggcttgggtctggtttttgcgggggatgatccggatcatcctgatggcgcgagggaggc

SEQ ID NO: 3298 - DNA, 495 bp, Artificial Sequence
  source: /note="Description of Artificial Sequence: Synthetic polynucleotide"
gccttgccagcccgctcaggatgatcctattggcgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctattggcggtcgacgggccaacgtcctgactttcggggccggcagcaggctgaccgtgctgggtgagttttcgcgggaccacccgggcggcgggattcaggtggaaggcggcgggatgatcctattggcgctgatggcgcgagggaggc

SEQ ID NO: 3299 - DNA, 495 bp, Artificial Sequence
  source: /note="Description of Artificial Sequence: Synthetic polynucleotide"
gccttgccagcccgctcaggatgatccaggcttgacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaggcttgagtcgacacgagcagtacttcgggccgggcaccaggctcacggtcacaggtgagattcgggcgtctccccaccttccagcccctcggtccccggagtcggagggtgggatgatccaggcttgactgatggcgcgagggaggc

SEQ ID NO: 3300 - DNA, 495 bp, Artificial Sequence
  source: /note="Description of Artificial Sequence: Synthetic polynucleotide"
gccttgccagcccgctcagcgccaatagacactctcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagacactctgtcgacactgaagctttctttggacaaggcaccagactcacagttgtaggtaagacatttttcaggttcttttgcagatccgtcacagggaaaagtgggtccacagcgccaatagacactctctgatggcgcgagggaggc

SEQ ID NO: 3301 - DNA, 495 bp, Artificial Sequence
  source: /note="Description of Artificial Sequence: Synthetic polynucleotide"
gccttgccagcccgctcagcgccaatattcggaaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatattcggaacgtcgactatggctacaccttcggttcggggaccaggttaaccgttgtaggtaaggctgggggtctctaggaggggtgcgatgagggaggactctgtcctgggaaatcgccaatattcggaacctgatggcgcgagggaggc

SEQ ID NO: 3302 - DNA, 495 bp, Artificial Sequence
  source: /note="Description of Artificial Sequence: Synthetic polynucleotide"
gccttgccagcccgctcagcgccaataaagtaacgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaagtaacggtcgacgaaacaccatatattttggagagggaagttggctcactgttgtaggtgagtaagtcaaggctggacagctgggaacttgcaaaaaggggctggaatccagcgccaataaagtaacgctgatggcgcgagggaggc

SEQ ID NO: 3303 - DNA, 495 bp, Artificial Sequence
  source: /note="Description of Artificial Sequence: Synthetic polynucleotide"
gccttgccagcccgctcagcgccaatagtctcctacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtctcctagtcgacaatgaaaaactgttttttggcagtggaacccagctctctgtcttgggtatgtaaaagacttctttcgggatagtgtatcataaggtcggagttccaggagcgccaatagtctcctactgatggcgcgagggaggc

SEQ ID NO: 3304 - DNA, 495 bp, Artificial Sequence
  source: /note="Description of Artificial Sequence: Synthetic polynucleotide"
gccttgccagcccgctcagcgccaataagagtgtccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataagagtgtcgtcgacatcagccccagcattttggtgatgggactcgactctccatcctaggtaagttgcagaatcagggtggtatggccattgtcccttgaaggcagagttctctcgccaataagagtgtcctgatggcgcgagggaggc

SEQ ID NO: 3305 - DNA, 495 bp, Artificial Sequence
  source: /note="Description of Artificial Sequence: Synthetic polynucleotide"
gccttgccagcccgctcagcgccaatagttccgaacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagttccgaagtcgacataattcacccctccactttgggaacgggaccaggctcactgtgacaggtatgggggctccactcttgactcgggggtgcctgggtttgactgcaatgatcgccaatagttccgaactgatggcgcgagggaggc

SEQ ID NO: 3306 - DNA, 495 bp, Artificial Sequence
  source: /note="Description of Artificial Sequence: Synthetic polynucleotide"
gccttgccagcccgctcagcgccaatacgttacttcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatacgttacttgtcgacacaatgagcagttcttcgggccagggacacggctcaccgtgctaggtaagaagggggctccaggtgggagagagggtgagcagcccagcctgcacgaccccgccaatacgttacttctgatggcgcgagggaggc

SEQ ID NO: 3307 - DNA, 495 bp, Artificial Sequence
  source: /note="Description of Artificial Sequence: Synthetic polynucleotide"
gccttgccagcccgctcagcgccaatataggagaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatataggagacgtcgacaccggggagctgttttttggagaaggctctaggctgaccgtactgggtaaggaggcggttggggctccggagagctccgagagggcgggatgggcagaggcgccaatataggagacctgatggcgcgagggaggc

SEQ ID NO: 3308 - DNA, 495 bp, Artificial Sequence
  source: /note="Description of Artificial Sequence: Synthetic polynucleotide"
gccttgccagcccgctcagcgccaatagtgtctaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtgtctacgtcgacagatacgcagtattttggcccaggcacccggctgacagtgctcggtaagcgggggctcccgctgaagccccggaactggggagggggcgccccgggacgccgccaatagtgtctacctgatggcgcgagggaggc

SEQ ID NO: 3309 - DNA, 495 bp, Artificial Sequence
  source: /note="Description of Artificial Sequence: Synthetic polynucleotide"
gccttgccagcccgctcagcgccaatagtacagtgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtacagtggtcgacaaaacattcagtacttcggcgccgggacccggctctcagtgctgggtaagctggggccgccgggggaccggggacgagactgcgctcgggtttttgtgcgcgccaatagtacagtgctgatggcgcgagggaggc

SEQ ID NO: 3310 - DNA, 495 bp, Artificial Sequence
  source: /note="Description of Artificial Sequence: Synthetic polynucleotide"
gccttgccagcccgctcagcgccaataggatcatccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataggatcatcgtcgacgagacccagtacttcgggccaggcacgcggctcctggtgctcggtgagcgcgggctgctggggcgcgggcgcgggcggcttgggtctggtttttgcggggcgccaataggatcatcctgatggcgcgagggaggc

SEQ ID NO: 3311 - DNA, 495 bp, Artificial Sequence
  source: /note="Description of Artificial Sequence: Synthetic polynucleotide"
gccttgccagcccgctcagcgccaatatattggcgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatatattggcggtcgacgggccaacgtcctgactttcggggccggcagcaggctgaccgtgctgggtgagttttcgcgggaccacccgggcggcgggattcaggtggaaggcggcggcgccaatatattggcgctgatggcgcgagggaggc

SEQ ID NO: 3312 - DNA, 495 bp, Artificial Sequence
  source: /note="Description of Artificial Sequence: Synthetic polynucleotide"
gccttgccagcccgctcagcgccaataaggcttgacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaggcttgagtcgacacgagcagtacttcgggccgggcaccaggctcacggtcacaggtgagattcgggcgtctccccaccttccagcccctcggtccccggagtcggagggtggcgccaataaggcttgactgatggcgcgagggaggc

SEQ ID NO: 3313 - DNA, 495 bp, Artificial Sequence
  source: /note="Description of Artificial Sequence: Synthetic polynucleotide"
gccttgccagcccgctcagtcaagcctgacactctcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgacactctgtcgacactgaagctttctttggacaaggcaccagactcacagttgtaggtaagacatttttcaggttcttttgcagatccgtcacagggaaaagtgggtccacagtcaagcctgacactctctgatggcgcgagggaggc

SEQ ID NO: 3314 - DNA, 495 bp, Artificial Sequence
  source: /note="Description of Artificial Sequence: Synthetic polynucleotide"
gccttgccagcccgctcagtcaagcctttcggaaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctttcggaacgtcgactatggctacaccttcggttcggggaccaggttaaccgttgtaggtaaggctgggggtctctaggaggggtgcgatgagggaggactctgtcctgggaaattcaagcctttcggaacctgatggcgcgagggaggc

SEQ ID NO: 3315 - DNA, 495 bp, Artificial Sequence
  source: /note="Description of Artificial Sequence: Synthetic polynucleotide"
gccttgccagcccgctcagtcaagcctaagtaacgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaagtaacggtcgacgaaacaccatatattttggagagggaagttggctcactgttgtaggtgagtaagtcaaggctggacagctgggaacttgcaaaaaggggctggaatccagtcaagcctaagtaacgctgatggcgcgagggaggc

SEQ ID NO: 3316 - DNA, 495 bp, Artificial Sequence
  source: /note="Description of Artificial Sequence: Synthetic polynucleotide"
gccttgccagcccgctcagtcaagcctgtctcctacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtctcctagtcgacaatgaaaaactgttttttggcagtggaacccagctctctgtcttgggtatgtaaaagacttctttcgggatagtgtatcataaggtcggagttccaggagtcaagcctgtctcctactgatggcgcgagggaggc

SEQ ID NO: 3317 - DNA, 495 bp, Artificial Sequence
  source: /note="Description of Artificial Sequence: Synthetic polynucleotide"
gccttgccagcccgctcagtcaagcctagagtgtccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctagagtgtcgtcgacatcagccccagcattttggtgatgggactcgactctccatcctaggtaagttgcagaatcagggtggtatggccattgtcccttgaaggcagagttctcttcaagcctagagtgtcctgatggcgcgagggaggc

SEQ ID NO: 3318 - DNA, 495 bp, Artificial Sequence
  source: /note="Description of Artificial Sequence: Synthetic polynucleotide"
gccttgccagcccgctcagtcaagcctgttccgaacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgttccgaagtcgacataattcacccctccactttgggaacgggaccaggctcactgtgacaggtatgggggctccactcttgactcgggggtgcctgggtttgactgcaatgattcaagcctgttccgaactgatggcgcgagggaggc

SEQ ID NO: 3319 - DNA, 495 bp, Artificial Sequence
  source: /note="Description of Artificial Sequence: Synthetic polynucleotide"
gccttgccagcccgctcagtcaagcctcgttacttcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctcgttacttgtcgacacaatgagcagttcttcgggccagggacacggctcaccgtgctaggtaagaagggggctccaggtgggagagagggtgagcagcccagcctgcacgaccctcaagcctcgttacttctgatggcgcgagggaggc

SEQ ID NO: 3320 - DNA, 495 bp, Artificial Sequence
  source: /note="Description of Artificial Sequence: Synthetic polynucleotide"
gccttgccagcccgctcagtcaagccttaggagaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttaggagacgtcgacaccggggagctgttttttggagaaggctctaggctgaccgtactgggtaaggaggcggttggggctccggagagctccgagagggcgggatgggcagaggtcaagccttaggagacctgatggcgcgagggaggc

SEQ ID NO: 3321 - DNA, 495 bp, Artificial Sequence
  source: /note="Description of Artificial Sequence: Synthetic polynucleotide"
gccttgccagcccgctcagtcaagcctgtgtctaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtgtctacgtcgacagatacgcagtattttggcccaggcacccggctgacagtgctcggtaagcgggggctcccgctgaagccccggaactggggagggggcgccccgggacgctcaagcctgtgtctacctgatggcgcgagggaggc

SEQ ID NO: 3322 - DNA, 495 bp, Artificial Sequence
  source: /note="Description of Artificial Sequence: Synthetic polynucleotide"
gccttgccagcccgctcagtcaagcctgtacagtgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtacagtggtcgacaaaacattcagtacttcggcgccgggacccggctctcagtgctgggtaagctggggccgccgggggaccggggacgagactgcgctcgggtttttgtgcgtcaagcctgtacagtgctgatggcgcgagggaggc

SEQ ID NO: 3323 - DNA, 495 bp, Artificial Sequence
  source: /note="Description of Artificial Sequence: Synthetic polynucleotide"
gccttgccagcccgctcagtcaagcctggatcatccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctggatcatcgtcgacgagacccagtacttcgggccaggcacgcggctcctggtgctcggtgagcgcgggctgctggggcgcgggcgcgggcggcttgggtctggtttttgcggggtcaagcctggatcatcctgatggcgcgagggaggc

SEQ ID NO: 3324 - DNA, 495 bp, Artificial Sequence
  source: /note="Description of Artificial Sequence: Synthetic polynucleotide"
gccttgccagcccgctcagtcaagccttattggcgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttattggcggtcgacgggccaacgtcctgactttcggggccggcagcaggctgaccgtgctgggtgagttttcgcgggaccacccgggcggcgggattcaggtggaaggcggcggtcaagccttattggcgctgatggcgcgagggaggc

SEQ ID NO: 3325 - DNA, 495 bp, Artificial Sequence
  source: /note="Description of Artificial Sequence: Synthetic polynucleotide"
gccttgccagcccgctcagtcaagcctaggcttgacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaggcttgagtcgacacgagcagtacttcgggccgggcaccaggctcacggtcacaggtgagattcgggcgtctccccaccttccagcccctcggtccccggagtcggagggtggtcaagcctaggcttgactgatggcgcgagggaggc

SEQ ID NO: 3326 - DNA, 495 bp, Artificial Sequence
  source: /note="Description of Artificial Sequence: Synthetic polynucleotide"
gccttgccagcccgctcagacgtgtgtgacactctcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgacactctgtcgacactgaagctttctttggacaaggcaccagactcacagttgtaggtaagacatttttcaggttcttttgcagatccgtcacagggaaaagtgggtccacagacgtgtgtgacactctctgatggcgcgagggaggc

SEQ ID NO: 3327 - DNA, 495 bp, Artificial Sequence
  source: /note="Description of Artificial Sequence: Synthetic polynucleotide"
gccttgccagcccgctcagacgtgtgtttcggaaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtttcggaacgtcgactatggctacaccttcggttcggggaccaggttaaccgttgtaggtaaggctgggggtctctaggaggggtgcgatgagggaggactctgtcctgggaaatacgtgtgtttcggaacctgatggcgcgagggaggc

SEQ ID NO: 3328 - DNA, 495 bp, Artificial Sequence
  source: /note="Description of Artificial Sequence: Synthetic polynucleotide"
gccttgccagcccgctcagacgtgtgtaagtaacgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaagtaacggtcgacgaaacaccatatattttggagagggaagttggctcactgttgtaggtgagtaagtcaaggctggacagctgggaacttgcaaaaaggggctggaatccagacgtgtgtaagtaacgctgatggcgcgagggaggc

SEQ ID NO: 3329 - DNA, 495 bp, Artificial Sequence
  source: /note="Description of Artificial Sequence: Synthetic polynucleotide"
gccttgccagcccgctcagacgtgtgtgtctcctacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtctcctagtcgacaatgaaaaactgttttttggcagtggaacccagctctctgtcttgggtatgtaaaagacttctttcgggatagtgtatcataaggtcggagttccaggagacgtgtgtgtctcctactgatggcgcgagggaggc

SEQ ID NO: 3330 - DNA, 495 bp, Artificial Sequence
  source: /note="Description of Artificial Sequence: Synthetic polynucleotide"
gccttgccagcccgctcagacgtgtgtagagtgtccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtagagtgtcgtcgacatcagccccagcattttggtgatgggactcgactctccatcctaggtaagttgcagaatcagggtggtatggccattgtcccttgaaggcagagttctctacgtgtgtagagtgtcctgatggcgcgagggaggc

SEQ ID NO: 3331 - DNA, 495 bp, Artificial Sequence
  source: /note="Description of Artificial Sequence: Synthetic polynucleotide"
gccttgccagcccgctcagacgtgtgtgttccgaacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgttccgaagtcgacataattcacccctccactttgggaacgggaccaggctcactgtgacaggtatgggggctccactcttgactcgggggtgcctgggtttgactgcaatgatacgtgtgtgttccgaactgatggcgcgagggaggc

SEQ ID NO: 3332 - DNA, 495 bp, Artificial Sequence
  source: /note="Description of Artificial Sequence: Synthetic polynucleotide"
gccttgccagcccgctcagacgtgtgtcgttacttcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtcgttacttgtcgacacaatgagcagttcttcgggccagggacacggctcaccgtgctaggtaagaagggggctccaggtgggagagagggtgagcagcccagcctgcacgacccacgtgtgtcgttacttctgatggcgcgagggaggc

SEQ ID NO: 3333 - DNA, 495 bp, Artificial Sequence
  source: /note="Description of Artificial Sequence: Synthetic polynucleotide"
gccttgccagcccgctcagacgtgtgttaggagaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttaggagacgtcgacaccggggagctgttttttggagaaggctctaggctgaccgtactgggtaaggaggcggttggggctccggagagctccgagagggcgggatgggcagaggacgtgtgttaggagacctgatggcgcgagggaggc

SEQ ID NO: 3334 - DNA, 495 bp, Artificial Sequence
  source: /note="Description of Artificial Sequence: Synthetic polynucleotide"
gccttgccagcccgctcagacgtgtgtgtgtctaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtgtctacgtcgacagatacgcagtattttggcccaggcacccggctgacagtgctcggtaagcgggggctcccgctgaagccccggaactggggagggggcgccccgggacgcacgtgtgtgtgtctacctgatggcgcgagggaggc

SEQ ID NO: 3335 - DNA, 495 bp, Artificial Sequence
  source: /note="Description of Artificial Sequence: Synthetic polynucleotide"
gccttgccagcccgctcagacgtgtgtgtacagtgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtacagtggtcgacaaaacattcagtacttcggcgccgggacccggctctcagtgctgggtaagctggggccgccgggggaccggggacgagactgcgctcgggtttttgtgcgacgtgtgtgtacagtgctgatggcgcgagggaggc

SEQ ID NO: 3336 - DNA, 495 bp, Artificial Sequence
  source: /note="Description of Artificial Sequence: Synthetic polynucleotide"
gccttgccagcccgctcagacgtgtgtggatcatccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtggatcatcgtcgacgagacccagtacttcgggccaggcacgcggctcctggtgctcggtgagcgcgggctgctggggcgcgggcgcgggcggcttgggtctggtttttgcggggacgtgtgtggatcatcctgatggcgcgagggaggc

SEQ ID NO: 3337 - DNA, 495 bp, Artificial Sequence
  source: /note="Description of Artificial Sequence: Synthetic polynucleotide"
gccttgccagcccgctcagacgtgtgttattggcgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttattggcggtcgacgggccaacgtcctgactttcggggccggcagcaggctgaccgtgctgggtgagttttcgcgggaccacccgggcggcgggattcaggtggaaggcggcggacgtgtgttattggcgctgatggcgcgagggaggc

SEQ ID NO: 3338 - DNA, 495 bp, Artificial Sequence
  source: /note="Description of Artificial Sequence: Synthetic polynucleotide"
gccttgccagcccgctcagacgtgtgtaggcttgacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaggcttgagtcgacacgagcagtacttcgggccgggcaccaggctcacggtcacaggtgagattcgggcgtctccccaccttccagcccctcggtccccggagtcggagggtggacgtgtgtaggcttgactgatggcgcgagggaggc

SEQ ID NO: 3339 - DNA, 495 bp, Artificial Sequence
  source: /note="Description of Artificial Sequence: Synthetic polynucleotide"
gccttgccagcccgctcagtccgtctagacactctcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagacactctgtcgacactgaagctttctttggacaaggcaccagactcacagttgtaggtaagacatttttcaggttcttttgcagatccgtcacagggaaaagtgggtccacagtccgtctagacactctctgatggcgcgagggaggc

SEQ ID NO: 3340 - DNA, 495 bp, Artificial Sequence
  source: /note="Description of Artificial Sequence: Synthetic polynucleotide"
gccttgccagcccgctcagtccgtctattcggaaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctattcggaacgtcgactatggctacaccttcggttcggggaccaggttaaccgttgtaggtaaggctgggggtctctaggaggggtgcgatgagggaggactctgtcctgggaaattccgtctattcggaacctgatggcgcgagggaggc

SEQ ID NO: 3341 - DNA, 495 bp, Artificial Sequence
  source: /note="Description of Artificial Sequence: Synthetic polynucleotide"
gccttgccagcccgctcagtccgtctaaagtaacgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaagtaacggtcgacgaaacaccatatattttggagagggaagttggctcactgttgtaggtgagtaagtcaaggctggacagctgggaacttgcaaaaaggggctggaatccagtccgtctaaagtaacgctgatggcgcgagggaggc

SEQ ID NO: 3342 - DNA, 495 bp, Artificial Sequence
  source: /note="Description of Artificial Sequence: Synthetic polynucleotide"
gccttgccagcccgctcagtccgtctagtctcctacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtctcctagtcgacaatgaaaaactgttttttggcagtggaacccagctctctgtcttgggtatgtaaaagacttctttcgggatagtgtatcataaggtcggagttccaggagtccgtctagtctcctactgatggcgcgagggaggc

SEQ ID NO: 3343 - DNA, 495 bp, Artificial Sequence
  source: /note="Description of Artificial Sequence: Synthetic polynucleotide"
gccttgccagcccgctcagtccgtctaagagtgtccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaagagtgtcgtcgacatcagccccagcattttggtgatgggactcgactctccatcctaggtaagttgcagaatcagggtggtatggccattgtcccttgaaggcagagttctcttccgtctaagagtgtcctgatggcgcgagggaggc

SEQ ID NO: 3344 - DNA, 495 bp, Artificial Sequence
  source: /note="Description of Artificial Sequence: Synthetic polynucleotide"
gccttgccagcccgctcagtccgtctagttccgaacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagttccgaagtcgacataattcacccctccactttgggaacgggaccaggctcactgtgacaggtatgggggctccactcttgactcgggggtgcctgggtttgactgcaatgattccgtctagttccgaactgatggcgcgagggaggc

SEQ ID NO: 3345 - DNA, 495 bp, Artificial Sequence
  source: /note="Description of Artificial Sequence: Synthetic polynucleotide"
gccttgccagcccgctcagtccgtctacgttacttcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctacgttacttgtcgacacaatgagcagttcttcgggccagggacacggctcaccgtgctaggtaagaagggggctccaggtgggagagagggtgagcagcccagcctgcacgaccctccgtctacgttacttctgatggcgcgagggaggc

SEQ ID NO: 3346 - DNA, 495 bp, Artificial Sequence
  source: /note="Description of Artificial Sequence: Synthetic polynucleotide"
gccttgccagcccgctcagtccgtctataggagaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctataggagacgtcgacaccggggagctgttttttggagaaggctctaggctgaccgtactgggtaaggaggcggttggggctccggagagctccgagagggcgggatgggcagaggtccgtctataggagacctgatggcgcgagggaggc

SEQ ID NO: 3347 - DNA, 495 bp, Artificial Sequence
  source: /note="Description of Artificial Sequence: Synthetic polynucleotide"
gccttgccagcccgctcagtccgtctagtgtctaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtgtctacgtcgacagatacgcagtattttggcccaggcacccggctgacagtgctcggtaagcgggggctcccgctgaagccccggaactggggagggggcgccccgggacgctccgtctagtgtctacctgatggcgcgagggaggc

SEQ ID NO: 3348 - DNA, 495 bp, Artificial Sequence
  source: /note="Description of Artificial Sequence: Synthetic polynucleotide"
gccttgccagcccgctcagtccgtctagtacagtgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtacagtggtcgacaaaacattcagtacttcggcgccgggacccggctctcagtgctgggtaagctggggccgccgggggaccggggacgagactgcgctcgggtttttgtgcgtccgtctagtacagtgctgatggcgcgagggaggc

SEQ ID NO: 3349 - DNA, 495 bp, Artificial Sequence
  source: /note="Description of Artificial Sequence: Synthetic polynucleotide"
gccttgccagcccgctcagtccgtctaggatcatccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaggatcatcgtcgacgagacccagtacttcgggccaggcacgcggctcctggtgctcggtgagcgcgggctgctggggcgcgggcgcgggcggcttgggtctggtttttgcggggtccgtctaggatcatcctgatggcgcgagggaggc

SEQ ID NO: 3350 - DNA, 495 bp, Artificial Sequence
  source: /note="Description of Artificial Sequence: Synthetic polynucleotide"
gccttgccagcccgctcagtccgtctatattggcgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctatattggcggtcgacgggccaacgtcctgactttcggggccggcagcaggctgaccgtgctgggtgagttttcgcgggaccacccgggcggcgggattcaggtggaaggcggcggtccgtctatattggcgctgatggcgcgagggaggc

SEQ ID NO: 3351 - DNA, 495 bp, Artificial Sequence
  source: /note="Description of Artificial Sequence: Synthetic polynucleotide"
gccttgccagcccgctcagtccgtctaaggcttgacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaggcttgagtcgacacgagcagtacttcgggccgggcaccaggctcacggtcacaggtgagattcgggcgtctccccaccttccagcccctcggtccccggagtcggagggtggtccgtctaaggcttgactgatggcgcgagggaggc

SEQ ID NO: 3352 - DNA, 495 bp, Artificial Sequence
  source: /note="Description of Artificial Sequence: Synthetic polynucleotide"
gccttgccagcccgctcagaagagctggacactctcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggacactctgtcgacactgaagctttctttggacaaggcaccagactcacagttgtaggtaagacatttttcaggttcttttgcagatccgtcacagggaaaagtgggtccacagaagagctggacactctctgatggcgcgagggaggc

SEQ ID NO: 3353 - DNA, 495 bp, Artificial Sequence
  source: /note="Description of Artificial Sequence: Synthetic polynucleotide"
gccttgccagcccgctcagaagagctgttcggaaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgttcggaacgtcgactatggctacaccttcggttcggggaccaggttaaccgttgtaggtaaggctgggggtctctaggaggggtgcgatgagggaggactctgtcctgggaaataagagctgttcggaacctgatggcgcgagggaggc

SEQ ID NO: 3354 - DNA, 495 bp, Artificial Sequence
  source: /note="Description of Artificial Sequence: Synthetic polynucleotide"
gccttgccagcccgctcagaagagctgaagtaacgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaagtaacggtcgacgaaacaccatatattttggagagggaagttggctcactgttgtaggtgagtaagtcaaggctggacagctgggaacttgcaaaaaggggctggaatccagaagagctgaagtaacgctgatggcgcgagggaggc

SEQ ID NO: 3355 - DNA, 495 bp, Artificial Sequence
  source: /note="Description of Artificial Sequence: Synthetic polynucleotide"
gccttgccagcccgctcagaagagctggtctcctacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtctcctagtcgacaatgaaaaactgttttttggcagtggaacccagctctctgtcttgggtatgtaaaagacttctttcgggatagtgtatcataaggtcggagttccaggagaagagctggtctcctactgatggcgcgagggaggc

SEQ ID NO: 3356 - DNA, 495 bp, Artificial Sequence
  source: /note="Description of Artificial Sequence: Synthetic polynucleotide"
gccttgccagcccgctcagaagagctgagagtgtccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgagagtgtcgtcgacatcagccccagcattttggtgatgggactcgactctccatcctaggtaagttgcagaatcagggtggtatggccattgtcccttgaaggcagagttctctaagagctgagagtgtcctgatggcgcgagggaggc

SEQ ID NO: 3357 - DNA, 495 bp, Artificial Sequence
  source: /note="Description of Artificial Sequence: Synthetic polynucleotide"
gccttgccagcccgctcagaagagctggttccgaacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggttccgaagtcgacataattcacccctccactttgggaacgggaccaggctcactgtgacaggtatgggggctccactcttgactcgggggtgcctgggtttgactgcaatgataagagctggttccgaactgatggcgcgagggaggc

SEQ ID NO: 3358 - DNA, 495 bp, Artificial Sequence
  source: /note="Description of Artificial Sequence: Synthetic polynucleotide"
gccttgccagcccgctcagaagagctgcgttacttcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgcgttacttgtcgacacaatgagcagttcttcgggccagggacacggctcaccgtgctaggtaagaagggggctccaggtgggagagagggtgagcagcccagcctgcacgacccaagagctgcgttacttctgatggcgcgagggaggc

SEQ ID NO: 3359 - DNA, 495 bp, Artificial Sequence
  source: /note="Description of Artificial Sequence: Synthetic polynucleotide"
gccttgccagcccgctcagaagagctgtaggagaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtaggagacgtcgacaccggggagctgttttttggagaaggctctaggctgaccgtactgggtaaggaggcggttggggctccggagagctccgagagggcgggatgggcagaggaagagctgtaggagacctgatggcgcgagggaggc

SEQ ID NO: 3360 - DNA, 495 bp, Artificial Sequence
  source: /note="Description of Artificial Sequence: Synthetic polynucleotide"
gccttgccagcccgctcagaagagctggtgtctaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtgtctacgtcgacagatacgcagtattttggcccaggcacccggctgacagtgctcggtaagcgggggctcccgctgaagccccggaactggggagggggcgccccgggacgcaagagctggtgtctacctgatggcgcgagggaggc

SEQ ID NO: 3361 - DNA, 495 bp, Artificial Sequence
  source: /note="Description of Artificial Sequence: Synthetic polynucleotide"
gccttgccagcccgctcagaagagctggtacagtgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtacagtggtcgacaaaacattcagtacttcggcgccgggacccggctctcagtgctgggtaagctggggccgccgggggaccggggacgagactgcgctcgggtttttgtgcgaagagctggtacagtgctgatggcgcgagggaggc

SEQ ID NO: 3362 - DNA, 495 bp, Artificial Sequence
  source: /note="Description of Artificial Sequence: Synthetic polynucleotide"
gccttgccagcccgctcagaagagctgggatcatccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgggatcatcgtcgacgagacccagtacttcgggccaggcacgcggctcctggtgctcggtgagcgcgggctgctggggcgcgggcgcgggcggcttgggtctggtttttgcggggaagagctgggatcatcctgatggcgcgagggaggc

SEQ ID NO: 3363 - DNA, 495 bp, Artificial Sequence
  source: /note="Description of Artificial Sequence: Synthetic polynucleotide"
gccttgccagcccgctcagaagagctgtattggcgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtattggcggtcgacgggccaacgtcctgactttcggggccggcagcaggctgaccgtgctgggtgagttttcgcgggaccacccgggcggcgggattcaggtggaaggcggcggaagagctgtattggcgctgatggcgcgagggaggc

SEQ ID NO: 3364 - DNA, 495 bp, Artificial Sequence
  source: /note="Description of Artificial Sequence: Synthetic polynucleotide"
gccttgccagcccgctcagaagagctgaggcttgacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaggcttgagtcgacacgagcagtacttcgggccgggcaccaggctcacggtcacaggtgagattcgggcgtctccccaccttccagcccctcggtccccggagtcggagggtggaagagctgaggcttgactgatggcgcgagggaggc

SEQ ID NO: 3365 - DNA, 495 bp, Artificial Sequence
  source: /note="Description of Artificial Sequence: Synthetic polynucleotide"
gccttgccagcccgctcagtcagatgcgacactctcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgacactctgtcgacactgaagctttctttggacaaggcaccagactcacagttgtaggtaagacatttttcaggttcttttgcagatccgtcacagggaaaagtgggtccacagtcagatgcgacactctctgatggcgcgagggaggc

SEQ ID NO: 3366 - DNA, 495 bp, Artificial Sequence
  source: /note="Description of Artificial Sequence: Synthetic polynucleotide"
gccttgccagcccgctcagtcagatgcttcggaaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcttcggaacgtcgactatggctacaccttcggttcggggaccaggttaaccgttgtaggtaaggctgggggtctctaggaggggtgcgatgagggaggactctgtcctgggaaattcagatgcttcggaacctgatggcgcgagggaggc

SEQ ID NO: 3367 - DNA, 495 bp, Artificial Sequence
  source: /note="Description of Artificial Sequence: Synthetic polynucleotide"
gccttgccagcccgctcagtcagatgcaagtaacgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaagtaacggtcgacgaaacaccatatattttggagagggaagttggctcactgttgtaggtgagtaagtcaaggctggacagctgggaacttgcaaaaaggggctggaatccagtcagatgcaagtaacgctgatggcgcgagggaggc

SEQ ID NO: 3368 - DNA, 495 bp, Artificial Sequence
  source: /note="Description of Artificial Sequence: Synthetic polynucleotide"
gccttgccagcccgctcagtcagatgcgtctcctacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtctcctagtcgacaatgaaaaactgttttttggcagtggaacccagctctctgtcttgggtatgtaaaagacttctttcgggatagtgtatcataaggtcggagttccaggagtcagatgcgtctcctactgatggcgcgagggaggc

SEQ ID NO: 3369 - DNA, 495 bp, Artificial Sequence
  source: /note="Description of Artificial Sequence: Synthetic polynucleotide"
gccttgccagcccgctcagtcagatgcagagtgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcagagtgtcgtcgacatcagccccagcattttggtgatgggactcgactctccatcctaggtaagttgcagaatcagggtggtatggccattgtcccttgaaggcagagttctcttcagatgcagagtgtcctgatggcgcgagggaggc

SEQ ID NO: 3370 - DNA, 495 bp, Artificial Sequence
  source: /note="Description of Artificial Sequence: Synthetic polynucleotide"
gccttgccagcccgctcagtcagatgcgttccgaacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgttccgaagtcgacataattcacccctccactttgggaacgggaccaggctcactgtgacaggtatgggggctccactcttgactcgggggtgcctgggtttgactgcaatgattcagatgcgttccgaactgatggcgcgagggaggc

SEQ ID NO: 3371 - DNA, 495 bp, Artificial Sequence
  source: /note="Description of Artificial Sequence: Synthetic polynucleotide"
gccttgccagcccgctcagtcagatgccgttacttcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgccgttacttgtcgacacaatgagcagttcttcgggccagggacacggctcaccgtgctaggtaagaagggggctccaggtgggagagagggtgagcagcccagcctgcacgaccctcagatgccgttacttctgatggcgcgagggaggc

SEQ ID NO: 3372 - DNA, 495 bp, Artificial Sequence
  source: /note="Description of Artificial Sequence: Synthetic polynucleotide"
gccttgccagcccgctcagtcagatgctaggagaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctaggagacgtcgacaccggggagctgttttttggagaaggctctaggctgaccgtactgggtaaggaggcggttggggctccggagagctccgagagggcgggatgggcagaggtcagatgctaggagacctgatggcgcgagggaggc

SEQ ID NO: 3373 - DNA, 495 bp, Artificial Sequence
  source: /note="Description of Artificial Sequence: Synthetic polynucleotide"
gccttgccagcccgctcagtcagatgcgtgtctaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtgtctacgtcgacagatacgcagtattttggcccaggcacccggctgacagtgctcggtaagcgggggctcccgctgaagccccggaactggggagggggcgccccgggacgctcagatgcgtgtctacctgatggcgcgagggaggc

SEQ ID NO: 3374 - DNA, 495 bp, Artificial Sequence
  source: /note="Description of Artificial Sequence: Synthetic polynucleotide"
gccttgccagcccgctcagtcagatgcgtacagtgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtacagtggtcgacaaaacattcagtacttcggcgccgggacccggctctcagtgctgggtaagctggggccgccgggggaccggggacgagactgcgctcgggtttttgtgcgtcagatgcgtacagtgctgatggcgcgagggaggc

SEQ ID NO: 3375 - DNA, 495 bp, Artificial Sequence
  source: /note="Description of Artificial Sequence: Synthetic polynucleotide"
gccttgccagcccgctcagtcagatgcggatcatccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcggatcatcgtcgacgagacccagtacttcgggccaggcacgcggctcctggtgctcggtgagcgcgggctgctggggcgcgggcgcgggcggcttgggtctggtttttgcggggtcagatgcggatcatcctgatggcgcgagggaggc

SEQ ID NO: 3376 - DNA, 495 bp, Artificial Sequence
  source: /note="Description of Artificial Sequence: Synthetic polynucleotide"
gccttgccagcccgctcagtcagatgctattggcgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctattggcggtcgacgggccaacgtcctgactttcggggccggcagcaggctgaccgtgctgggtgagttttcgcgggaccacccgggcggcgggattcaggtggaaggcggcggtcagatgctattggcgctgatggcgcgagggaggc

SEQ ID NO: 3377 - DNA, 495 bp, Artificial Sequence
  source: /note="Description of Artificial Sequence: Synthetic polynucleotide"
gccttgccagcccgctcagtcagatgcaggcttgacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaggcttgagtcgacacgagcagtacttcgggccgggcaccaggctcacggtcacaggtgagattcgggcgtctccccaccttccagcccctcggtccccggagtcggagggtggtcagatgcaggcttgactgatggcgcgagggaggc

SEQ ID NO: 3378 - DNA, 495 bp, Artificial Sequence
  source: /note="Description of Artificial Sequence: Synthetic polynucleotide"
gccttgccagcccgctcaggtgtagcagacactctcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagacactctgtcgacactgaagctttctttggacaaggcaccagactcacagttgtaggtaagacatttttcaggttcttttgcagatccgtcacagggaaaagtgggtccacaggtgtagcagacactctctgatggcgcgagggaggc

SEQ ID NO: 3379 - DNA, 495 bp, Artificial Sequence
  source: /note="Description of Artificial Sequence: Synthetic polynucleotide"
gccttgccagcccgctcaggtgtagcattcggaaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcattcggaacgtcgactatggctacaccttcggttcggggaccaggttaaccgttgtaggtaaggctgggggtctctaggaggggtgcgatgagggaggactctgtcctgggaaatgtgtagcattcggaacctgatggcgcgagggaggc

SEQ ID NO: 3380 - DNA, 495 bp, Artificial Sequence
  source: /note="Description of Artificial Sequence: Synthetic polynucleotide"
gccttgccagcccgctcaggtgtagcaaagtaacgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaagtaacggtcgacgaaacaccatatattttggagagggaagttggctcactgttgtaggtgagtaagtcaaggctggacagctgggaacttgcaaaaaggggctggaatccaggtgtagcaaagtaacgctgatggcgcgagggaggc

SEQ ID NO: 3381 - DNA, 495 bp, Artificial Sequence
  source: /note="Description of Artificial Sequence: Synthetic polynucleotide"
gccttgccagcccgctcaggtgtagcagtctcctacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtctcctagtcgacaatgaaaaactgttttttggcagtggaacccagctctctgtcttgggtatgtaaaagacttctttcgggatagtgtatcataaggtcggagttccaggaggtgtagcagtctcctactgatggcgcgagggaggc

SEQ ID NO: 3382 - DNA, 495 bp, Artificial Sequence
  source: /note="Description of Artificial Sequence: Synthetic polynucleotide"
gccttgccagcccgctcaggtgtagcaagagtgtccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaagagtgtcgtcgacatcagccccagcattttggtgatgggactcgactctccatcctaggtaagttgcagaatcagggtggtatggccattgtcccttgaaggcagagttctctgtgtagcaagagtgtcctgatggcgcgagggaggc

SEQ ID NO: 3383 - DNA, 495 bp, Artificial Sequence
  source: /note="Description of Artificial Sequence: Synthetic polynucleotide"
gccttgccagcccgctcaggtgtagcagttccgaacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagttccgaagtcgacataattcacccctccactttgggaacgggaccaggctcactgtgacaggtatgggggctccactcttgactcgggggtgcctgggtttgactgcaatgatgtgtagcagttccgaactgatggcgcgagggaggc

SEQ ID NO: 3384 - DNA, 495 bp, Artificial Sequence
  source: /note="Description of Artificial Sequence: Synthetic polynucleotide"
gccttgccagcccgctcaggtgtagcacgttacttcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcacgttacttgtcgacacaatgagcagttcttcgggccagggacacggctcaccgtgctaggtaagaagggggctccaggtgggagagagggtgagcagcccagcctgcacgacccgtgtagcacgttacttctgatggcgcgagggaggc

SEQ ID NO: 3385 - DNA, 495 bp, Artificial Sequence
  source: /note="Description of Artificial Sequence: Synthetic polynucleotide"
gccttgccagcccgctcaggtgtagcataggagaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcataggagacgtcgacaccggggagctgttttttggagaaggctctaggctgaccgtactgggtaaggaggcggttggggctccggagagctccgagagggcgggatgggcagagggtgtagcataggagacctgatggcgcgagggaggc

SEQ ID NO: 3386 - DNA, 495 bp, Artificial Sequence
  source: /note="Description of Artificial Sequence: Synthetic polynucleotide"
gccttgccagcccgctcaggtgtagcagtgtctaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtgtctacgtcgacagatacgcagtattttggcccaggcacccggctgacagtgctcggtaagcgggggctcccgctgaagccccggaactggggagggggcgccccgggacgcgtgtagcagtgtctacctgatggcgcgagggaggc

SEQ ID NO: 3387 - DNA, 495 bp, Artificial Sequence
  source: /note="Description of Artificial Sequence: Synthetic polynucleotide"
gccttgccagcccgctcaggtgtagcagtacagtgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtacagtggtcgacaaaacattcagtacttcggcgccgggacccggctctcagtgctgggtaagctggggccgccgggggaccggggacgagactgcgctcgggtttttgtgcggtgtagcagtacagtgctgatggcgcgagggaggc

SEQ ID NO: 3388 - DNA, 495 bp, Artificial Sequence
  source: /note="Description of Artificial Sequence: Synthetic polynucleotide"
gccttgccagcccgctcaggtgtagcaggatcatccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaggatcatcgtcgacgagacccagtacttcgggccaggcacgcggctcctggtgctcggtgagcgcgggctgctggggcgcgggcgcgggcggcttgggtctggtttttgcgggggtgtagcaggatcatcctgatggcgcgagggaggc

SEQ ID NO: 3389 - DNA, 495 bp, Artificial Sequence
  source: /note="Description of Artificial Sequence: Synthetic polynucleotide"
gccttgccagcccgctcaggtgtagcatattggcgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcatattggcggtcgacgggccaacgtcctgactttcggggccggcagcaggctgaccgtgctgggtgagttttcgcgggaccacccgggcggcgggattcaggtggaaggcggcgggtgtagcatattggcgctgatggcgcgagggaggc

SEQ ID NO: 3390 - DNA, 495 bp, Artificial Sequence
  source: /note="Description of Artificial Sequence: Synthetic polynucleotide"
gccttgccagcccgctcaggtgtagcaaggcttgacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaggcttgagtcgacacgagcagtacttcgggccgggcaccaggctcacggtcacaggtgagattcgggcgtctccccaccttccagcccctcggtccccggagtcggagggtgggtgtagcaaggcttgactgatggcgcgagggaggc

SEQ ID NO: 3391 - DNA, 495 bp, Artificial Sequence
  source: /note="Description of Artificial Sequence: Synthetic polynucleotide"
gccttgccagcccgctcagtggcagttgacactctcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgacactctgtcgacactgaagctttctttggacaaggcaccagactcacagttgtaggtaagacatttttcaggttcttttgcagatccgtcacagggaaaagtgggtccacagtggcagttgacactctctgatggcgcgagggaggc

SEQ ID NO: 3392 - DNA, 495 bp, Artificial Sequence
  source: /note="Description of Artificial Sequence: Synthetic polynucleotide"
gccttgccagcccgctcagtggcagttttcggaaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttttcggaacgtcgactatggctacaccttcggttcggggaccaggttaaccgttgtaggtaaggctgggggtctctaggaggggtgcgatgagggaggactctgtcctgggaaattggcagttttcggaacctgatggcgcgagggaggc

SEQ ID NO: 3393 - DNA, 495 bp, Artificial Sequence
  source: /note="Description of Artificial Sequence: Synthetic polynucleotide"
gccttgccagcccgctcagtggcagttaagtaacgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaagtaacggtcgacgaaacaccatatattttggagagggaagttggctcactgttgtaggtgagtaagtcaaggctggacagctgggaacttgcaaaaaggggctggaatccagtggcagttaagtaacgctgatggcgcgagggaggc

SEQ ID NO: 3394 - DNA, 495 bp, Artificial Sequence
  source: /note="Description of Artificial Sequence: Synthetic polynucleotide"
gccttgccagcccgctcagtggcagttgtctcctacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtctcctagtcgacaatgaaaaactgttttttggcagtggaacccagctctctgtcttgggtatgtaaaagacttctttcgggatagtgtatcataaggtcggagttccaggagtggcagttgtctcctactgatggcgcgagggaggc

SEQ ID NO: 3395 - DNA, 495 bp, Artificial Sequence
  source: /note="Description of Artificial Sequence: Synthetic polynucleotide"
gccttgccagcccgctcagtggcagttagagtgtccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttagagtgtcgtcgacatcagccccagcattttggtgatgggactcgactctccatcctaggtaagttgcagaatcagggtggtatggccattgtcccttgaaggcagagttctcttggcagttagagtgtcctgatggcgcgagggaggc

SEQ ID NO: 3396 - DNA, 495 bp, Artificial Sequence
  source: /note="Description of Artificial Sequence: Synthetic polynucleotide"
gccttgccagcccgctcagtggcagttgttccgaacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgttccgaagtcgacataattcacccctccactttgggaacgggaccaggctcactgtgacaggtatgggggctccactcttgactcgggggtgcctgggtttgactgcaatgattggcagttgttccgaactgatggcgcgagggaggc

SEQ ID NO: 3397 - DNA, 495 bp, Artificial Sequence
  source: /note="Description of Artificial Sequence: Synthetic polynucleotide"
gccttgccagcccgctcagtggcagttcgttacttcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttcgttacttgtcgacacaatgagcagttcttcgggccagggacacggctcaccgtgctaggtaagaagggggctccaggtgggagagagggtgagcagcccagcctgcacgaccctggcagttcgttacttctgatggcgcgagggaggc

SEQ ID NO: 3398 - DNA, 495 bp, Artificial Sequence
  source: /note="Description of Artificial Sequence: Synthetic polynucleotide"
gccttgccagcccgctcagtggcagtttaggagaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttaggagacgtcgacaccggggagctgttttttggagaaggctctaggctgaccgtactgggtaaggaggcggttggggctccggagagctccgagagggcgggatgggcagaggtggcagtttaggagacctgatggcgcgagggaggc

SEQ ID NO: 3399 - DNA, 495 bp, Artificial Sequence
  source: /note="Description of Artificial Sequence: Synthetic polynucleotide"
gccttgccagcccgctcagtggcagttgtgtctaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtgtctacgtcgacagatacgcagtattttggcccaggcacccggctgacagtgctcggtaagcgggggctcccgctgaagccccggaactggggagggggcgccccgggacgctggcagttgtgtctacctgatggcgcgagggaggc

SEQ ID NO: 3400 - DNA, 495 bp, Artificial Sequence
  source: /note="Description of Artificial Sequence: Synthetic polynucleotide"
gccttgccagcccgctcagtggcagttgtacagtgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtacagtggtcgacaaaacattcagtacttcggcgccgggacccggctctcagtgctgggtaagctggggccgccgggggaccggggacgagactgcgctcgggtttttgtgcgtggcagttgtacagtgctgatggcgcgagggaggc

SEQ ID NO: 3401 - DNA, 495 bp, Artificial Sequence
  source: /note="Description of Artificial Sequence: Synthetic polynucleotide"
gccttgccagcccgctcagtggcagttggatcatccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttggatcatcgtcgacgagacccagtacttcgggccaggcacgcggctcctggtgctcggtgagcgcgggctgctggggcgcgggcgcgggcggcttgggtctggtttttgcggggtggcagttggatcatcctgatggcgcgagggaggc

SEQ ID NO: 3402 - DNA, 495 bp, Artificial Sequence
  source: /note="Description of Artificial Sequence: Synthetic polynucleotide"
gccttgccagcccgctcagtggcagtttattggcgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttattggcggtcgacgggccaacgtcctgactttcggggccggcagcaggctgaccgtgctgggtgagttttcgcgggaccacccgggcggcgggattcaggtggaaggcggcggtggcagtttattggcgctgatggcgcgagggaggc

SEQ ID NO: 3403 - DNA, 495 bp, Artificial Sequence
  source: /note="Description of Artificial Sequence: Synthetic polynucleotide"
gccttgccagcccgctcagtggcagttaggcttgacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaggcttgagtcgacacgagcagtacttcgggccgggcaccaggctcacggtcacaggtgagattcgggcgtctccccaccttccagcccctcggtccccggagtcggagggtggtggcagttaggcttgactgatggcgcgagggaggc

SEQ ID NO: 3404 - DNA, 495 bp, Artificial Sequence
  source: /note="Description of Artificial Sequence: Synthetic polynucleotide"
gccttgccagcccgctcagcagtccaagacactctcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagacactctgtcgacactgaagctttctttggacaaggcaccagactcacagttgtaggtaagacatttttcaggttcttttgcagatccgtcacagggaaaagtgggtccacagcagtccaagacactctctgatggcgcgagggaggc

SEQ ID NO: 3405 - DNA, 495 bp, Artificial Sequence
  source: /note="Description of Artificial Sequence: Synthetic polynucleotide"
gccttgccagcccgctcagcagtccaattcggaaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaattcggaacgtcgactatggctacaccttcggttcggggaccaggttaaccgttgtaggtaaggctgggggtctctaggaggggtgcgatgagggaggactctgtcctgggaaatcagtccaattcggaacctgatggcgcgagggaggc

SEQ ID NO: 3406 - DNA, 495 bp, Artificial Sequence
  source: /note="Description of Artificial Sequence: Synthetic polynucleotide"
gccttgccagcccgctcagcagtccaaaagtaacgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaagtaacggtcgacgaaacaccatatattttggagagggaagttggctcactgttgtaggtgagtaagtcaaggctggacagctgggaacttgcaaaaaggggctggaatccagcagtccaaaagtaacgctgatggcgcgagggaggc

SEQ ID NO: 3407 - DNA, 495 bp, Artificial Sequence
  source: /note="Description of Artificial Sequence: Synthetic polynucleotide"
gccttgccagcccgctcagcagtccaagtctcctacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtctcctagtcgacaatgaaaaactgttttttggcagtggaacccagctctctgtcttgggtatgtaaaagacttctttcgggatagtgtatcataaggtcggagttccaggagcagtccaagtctcctactgatggcgcgagggaggc

SEQ ID NO: 3408 - DNA, 495 bp, Artificial Sequence
  source: /note="Description of Artificial Sequence: Synthetic polynucleotide"
gccttgccagcccgctcagcagtccaaagagtgtccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaagagtgtcgtcgacatcagccccagcattttggtgatgggactcgactctccatcctaggtaagttgcagaatcagggtggtatggccattgtcccttgaaggcagagttctctcagtccaaagagtgtcctgatggcgcgagggaggc

SEQ ID NO: 3409 - DNA, 495 bp, Artificial Sequence
  source: /note="Description of Artificial Sequence: Synthetic polynucleotide"
gccttgccagcccgctcagcagtccaagttccgaacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagttccgaagtcgacataattcacccctccactttgggaacgggaccaggctcactgtgacaggtatgggggctccactcttgactcgggggtgcctgggtttgactgcaatgatcagtccaagttccgaactgatggcgcgagggaggc

SEQ ID NO: 3410 - DNA, 495 bp, Artificial Sequence
  source: /note="Description of Artificial Sequence: Synthetic polynucleotide"
gccttgccagcccgctcagcagtccaacgttacttcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaacgttacttgtcgacacaatgagcagttcttcgggccagggacacggctcaccgtgctaggtaagaagggggctccaggtgggagagagggtgagcagcccagcctgcacgaccccagtccaacgttacttctgatggcgcgagggaggc

SEQ ID NO: 3411 - DNA, 495 bp, Artificial Sequence
  source: /note="Description of Artificial Sequence: Synthetic polynucleotide"
gccttgccagcccgctcagcagtccaataggagaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaataggagacgtcgacaccggggagctgttttttggagaaggctctaggctgaccgtactgggtaaggaggcggttggggctccggagagctccgagagggcgggatgggcagaggcagtccaataggagacctgatggcgcgagggaggc

SEQ ID NO: 3412 - DNA, 495 bp, Artificial Sequence
  source: /note="Description of Artificial Sequence: Synthetic polynucleotide"
gccttgccagcccgctcagcagtccaagtgtctaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtgtctacgtcgacagatacgcagtattttggcccaggcacccggctgacagtgctcggtaagcgggggctcccgctgaagccccggaactggggagggggcgccccgggacgccagtccaagtgtctacctgatggcgcgagggaggc

SEQ ID NO: 3413 - DNA, 495 bp, Artificial Sequence
  source: /note="Description of Artificial Sequence: Synthetic polynucleotide"
gccttgccagcccgctcagcagtccaagtacagtgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtacagtggtcgacaaaacattcagtacttcggcgccgggacccggctctcagtgctgggtaagctggggccgccgggggaccggggacgagactgcgctcgggtttttgtgcgcagtccaagtacagtgctgatggcgcgagggaggc

SEQ ID NO: 3414 - DNA, 495 bp, Artificial Sequence
  source: /note="Description of Artificial Sequence: Synthetic polynucleotide"
gccttgccagcccgctcagcagtccaaggatcatccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaggatcatcgtcgacgagacccagtacttcgggccaggcacgcggctcctggtgctcggtgagcgcgggctgctggggcgcgggcgcgggcggcttgggtctggtttttgcggggcagtccaaggatcatcctgatggcgcgagggaggc

SEQ ID NO: 3415 - DNA, 495 bp, Artificial Sequence
  source: /note="Description of Artificial Sequence: Synthetic polynucleotide"
gccttgccagcccgctcagcagtccaatattggcgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaatattggcggtcgacgggccaacgtcctgactttcggggccggcagcaggctgaccgtgctgggtgagttttcgcgggaccacccgggcggcgggattcaggtggaaggcggcggcagtccaatattggcgctgatggcgcgagggaggc

SEQ ID NO: 3416 - DNA, 495 bp, Artificial Sequence
  source: /note="Description of Artificial Sequence: Synthetic polynucleotide"
gccttgccagcccgctcagcagtccaaaggcttgacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaggcttgagtcgacacgagcagtacttcgggccgggcaccaggctcacggtcacaggtgagattcgggcgtctccccaccttccagcccctcggtccccggagtcggagggtggcagtccaaaggcttgactgatggcgcgagggaggc

SEQ ID NO: 3417 - DNA, 495 bp, Artificial Sequence
  source: /note="Description of Artificial Sequence: Synthetic polynucleotide"
gccttgccagcccgctcagtacgtacggacactctcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggacactctgtcgacactgaagctttctttggacaaggcaccagactcacagttgtaggtaagacatttttcaggttcttttgcagatccgtcacagggaaaagtgggtccacagtacgtacggacactctctgatggcgcgagggaggc

SEQ ID NO: 3418 - DNA, 495 bp, Artificial Sequence
  source: /note="Description of Artificial Sequence: Synthetic polynucleotide"
gccttgccagcccgctcagtacgtacgttcggaaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgttcggaacgtcgactatggctacaccttcggttcggggaccaggttaaccgttgtaggtaaggctgggggtctctaggaggggtgcgatgagggaggactctgtcctgggaaattacgtacgttcggaacctgatggcgcgagggaggc

SEQ ID NO: 3419 - DNA, 495 bp, Artificial Sequence
  source: /note="Description of Artificial Sequence: Synthetic polynucleotide"
gccttgccagcccgctcagtacgtacgaagtaacgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaagtaacggtcgacgaaacaccatatattttggagagggaagttggctcactgttgtaggtgagtaagtcaaggctggacagctgggaacttgcaaaaaggggctggaatccagtacgtacgaagtaacgctgatggcgcgagggaggc

SEQ ID NO: 3420 - DNA, 495 bp, Artificial Sequence
  source: /note="Description of Artificial Sequence: Synthetic polynucleotide"
gccttgccagcccgctcagtacgtacggtctcctacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtctcctagtcgacaatgaaaaactgttttttggcagtggaacccagctctctgtcttgggtatgtaaaagacttctttcgggatagtgtatcataaggtcggagttccaggagtacgtacggtctcctactgatggcgcgagggaggc

SEQ ID NO: 3421 - DNA, 495 bp, Artificial Sequence
  source: /note="Description of Artificial Sequence: Synthetic polynucleotide"
gccttgccagcccgctcagtacgtacgagagtgtccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgagagtgtcgtcgacatcagccccagcattttggtgatgggactcgactctccatcctaggtaagttgcagaatcagggtggtatggccattgtcccttgaaggcagagttctcttacgtacgagagtgtcctgatggcgcgagggaggc

SEQ ID NO: 3422 - DNA, 495 bp, Artificial Sequence
  source: /note="Description of Artificial Sequence: Synthetic polynucleotide"
gccttgccagcccgctcagtacgtacggttccgaacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggttccgaagtcgacataattcacccctccactttgggaacgggaccaggctcactgtgacaggtatgggggctccactcttgactcgggggtgcctgggtttgactgcaatgattacgtacggttccgaactgatggcgcgagggaggc

SEQ ID NO: 3423 - DNA, 495 bp, Artificial Sequence
  source: /note="Description of Artificial Sequence: Synthetic polynucleotide"
gccttgccagcccgctcagtacgtacgcgttacttcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgcgttacttgtcgacacaatgagcagttcttcgggccagggacacggctcaccgtgctaggtaagaagggggctccaggtgggagagagggtgagcagcccagcctgcacgaccctacgtacgcgttacttctgatggcgcgagggaggc

SEQ ID NO: 3424 - DNA, 495 bp, Artificial Sequence
  source: /note="Description of Artificial Sequence: Synthetic polynucleotide"
gccttgccagcccgctcagtacgtacgtaggagaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtaggagacgtcgacaccggggagctgttttttggagaaggctctaggctgaccgtactgggtaaggaggcggttggggctccggagagctccgagagggcgggatgggcagaggtacgtacgtaggagacctgatggcgcgagggaggc

SEQ ID NO: 3425 - DNA, 495 bp, Artificial Sequence
  source: /note="Description of Artificial Sequence: Synthetic polynucleotide"
gccttgccagcccgctcagtacgtacggtgtctaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtgtctacgtcgacagatacgcagtattttggcccaggcacccggctgacagtgctcggtaagcgggggctcccgctgaagccccggaactggggagggggcgccccgggacgctacgtacggtgtctacctgatggcgcgagggaggc

SEQ ID NO: 3426 - DNA, 495 bp, Artificial Sequence
  source: /note="Description of Artificial Sequence: Synthetic polynucleotide"
gccttgccagcccgctcagtacgtacggtacagtgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtacagtggtcgacaaaacattcagtacttcggcgccgggacccggctctcagtgctgggtaagctggggccgccgggggaccggggacgagactgcgctcgggtttttgtgcgtacgtacggtacagtgctgatggcgcgagggaggc

SEQ ID NO: 3427 - DNA, 495 bp, Artificial Sequence
  source: /note="Description of Artificial Sequence: Synthetic polynucleotide"
gccttgccagcccgctcagtacgtacgggatcatccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgggatcatcgtcgacgagacccagtacttcgggccaggcacgcggctcctggtgctcggtgagcgcgggctgctggggcgcgggcgcgggcggcttgggtctggtttttgcggggtacgtacgggatcatcctgatggcgcgagggaggc

SEQ ID NO: 3428 - DNA, 495 bp, Artificial Sequence
  source: /note="Description of Artificial Sequence: Synthetic polynucleotide"
gccttgccagcccgctcagtacgtacgtattggcgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtattggcggtcgacgggccaacgtcctgactttcggggccggcagcaggctgaccgtgctgggtgagttttcgcgggaccacccgggcggcgggattcaggtggaaggcggcggtacgtacgtattggcgctgatggcgcgagggaggc

SEQ ID NO: 3429 - DNA, 495 bp, Artificial Sequence
  source: /note="Description of Artificial Sequence: Synthetic polynucleotide"
gccttgccagcccgctcagtacgtacgaggcttgacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaggcttgagtcgacacgagcagtacttcgggccgggcaccaggctcacggtcacaggtgagattcgggcgtctccccaccttccagcccctcggtccccggagtcggagggtggtacgtacgaggcttgactgatggcgcgagggaggc

SEQ ID NO: 3430 - DNA, 495 bp, Artificial Sequence
  source: /note="Description of Artificial Sequence: Synthetic polynucleotide"
gccttgccagcccgctcagagtaccgagacactctgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagacactctgtcgacactgaagctttctttggacaaggcaccagactcacagttgtaggtaagacatttttcaggttcttttgcagatccgtcacagggaaaagtgggtccacagagtaccgagacactctctgatggcgcgagggaggc

SEQ ID NO: 3431 - DNA, 495 bp, Artificial Sequence
  source: /note="Description of Artificial Sequence: Synthetic polynucleotide"
gccttgccagcccgctcagagtaccgattcggaacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgattcggaacgtcgactatggctacaccttcggttcggggaccaggttaaccgttgtaggtaaggctgggggtctctaggaggggtgcgatgagggaggactctgtcctgggaaatagtaccgattcggaacctgatggcgcgagggaggc

SEQ ID NO: 3432 - DNA, 495 bp, Artificial Sequence
  source: /note="Description of Artificial Sequence: Synthetic polynucleotide"
gccttgccagcccgctcagagtaccgaaagtaacggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaagtaacggtcgacgaaacaccatatattttggagagggaagttggctcactgttgtaggtgagtaagtcaaggctggacagctgggaacttgcaaaaaggggctggaatccagagtaccgaaagtaacgctgatggcgcgagggaggc

SEQ ID NO: 3433 - DNA, 495 bp, Artificial Sequence
  source: /note="Description of Artificial Sequence: Synthetic polynucleotide"
gccttgccagcccgctcagagtaccgagtctcctagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtctcctagtcgacaatgaaaaactgttttttggcagtggaacccagctctctgtcttgggtatgtaaaagacttctttcgggatagtgtatcataaggtcggagttccaggagagtaccgagtctcctactgatggcgcgagggaggc

SEQ ID NO: 3434 - DNA, 495 bp, Artificial Sequence
  source: /note="Description of Artificial Sequence: Synthetic polynucleotide"
gccttgccagcccgctcagagtaccgaagagtgtcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaagagtgtcgtcgacatcagccccagcattttggtgatgggactcgactctccatcctaggtaagttgcagaatcagggtggtatggccattgtcccttgaaggcagagttctctagtaccgaagagtgtcctgatggcgcgagggaggc

SEQ ID NO: 3435 - DNA, 495 bp, Artificial Sequence
  source: /note="Description of Artificial Sequence: Synthetic polynucleotide"
gccttgccagcccgctcagagtaccgagttccgaagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagttccgaagtcgacataattcacccctccactttgggaacgggaccaggctcactgtgacaggtatgggggctccactcttgactcgggggtgcctgggtttgactgcaatgatagtaccgagttccgaactgatggcgcgagggaggc

SEQ ID NO: 3436 - DNA, 495 bp, Artificial Sequence
  source: /note="Description of Artificial Sequence: Synthetic polynucleotide"
gccttgccagcccgctcagagtaccgacgttacttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgacgttacttgtcgacacaatgagcagttcttcgggccagggacacggctcaccgtgctaggtaagaagggggctccaggtgggagagagggtgagcagcccagcctgcacgacccagtaccgacgttacttctgatggcgcgagggaggc

SEQ ID NO: 3437 - DNA, 495 bp, Artificial Sequence
  source: /note="Description of Artificial Sequence: Synthetic polynucleotide"
gccttgccagcccgctcagagtaccgataggagacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgataggagacgtcgacaccggggagctgttttttggagaaggctctaggctgaccgtactgggtaaggaggcggttggggctccggagagctccgagagggcgggatgggcagaggagtaccgataggagacctgatggcgcgagggaggc

SEQ ID NO: 3438 - DNA, 495 bp, Artificial Sequence
  source: /note="Description of Artificial Sequence: Synthetic polynucleotide"
gccttgccagcccgctcagagtaccgagtgtctacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtgtctacgtcgacagatacgcagtattttggcccaggcacccggctgacagtgctcggtaagcgggggctcccgctgaagccccggaactggggagggggcgccccgggacgcagtaccgagtgtctacctgatggcgcgagggaggc

SEQ ID NO: 3439 - DNA, 495 bp, Artificial Sequence
  source: /note="Description of Artificial Sequence: Synthetic polynucleotide"
gccttgccagcccgctcagagtaccgagtacagtggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtacagtggtcgacaaaacattcagtacttcggcgccgggacccggctctcagtgctgggtaagctggggccgccgggggaccggggacgagactgcgctcgggtttttgtgcgagtaccgagtacagtgctgatggcgcgagggaggc

SEQ ID NO: 3440 - DNA, 495 bp, Artificial Sequence
  source: /note="Description of Artificial Sequence: Synthetic polynucleotide"
gccttgccagcccgctcagagtaccgaggatcatcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaggatcatcgtcgacgagacccagtacttcgggccaggcacgcggctcctggtgctcggtgagcgcgggctgctggggcgcgggcgcgggcggcttgggtctggtttttgcggggagtaccgaggatcatcctgatggcgcgagggaggc

SEQ ID NO: 3441 - DNA, 495 bp, Artificial Sequence
  source: /note="Description of Artificial Sequence: Synthetic polynucleotide"
gccttgccagcccgctcagagtaccgatattggcggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgatattggcggtcgacgggccaacgtcctgactttcggggccggcagcaggctgaccgtgctgggtgagttttcgcgggaccacccgggcggcgggattcaggtggaaggcggcggagtaccgatattggcgctgatggcgcgagggaggc

SEQ ID NO: 3442 - DNA, 495 bp, Artificial Sequence
  source: /note="Description of Artificial Sequence: Synthetic polynucleotide"
gccttgccagcccgctcagagtaccgaaggcttgagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaggcttgagtcgacacgagcagtacttcgggccgggcaccaggctcacggtcacaggtgagattcgggcgtctccccaccttccagcccctcggtccccggagtcggagggtggagtaccgaaggcttgactgatggcgcgagggaggc

SEQ ID NO: 3443 - DNA, 495 bp, Artificial Sequence
  source: /note="Description of Artificial Sequence: Synthetic polynucleotide"
gccttgccagcccgctcagatccatgggacactctcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggacactctgtcgacactgaagctttctttggacaaggcaccagactcacagttgtaggtaagacatttttcaggttcttttgcagatccgtcacagggaaaagtgggtccacagatccatgggacactctctgatggcgcgagggaggc

SEQ ID NO: 3444 - DNA, 495 bp, Artificial Sequence
  source: /note="Description of Artificial Sequence: Synthetic polynucleotide"
gccttgccagcccgctcagatccatggttcggaaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggttcggaacgtcgactatggctacaccttcggttcggggaccaggttaaccgttgtaggtaaggctgggggtctctaggaggggtgcgatgagggaggactctgtcctgggaaatatccatggttcggaacctgatggcgcgagggaggc

SEQ ID NO: 3445 - DNA, 495 bp, Artificial Sequence
  source: /note="Description of Artificial Sequence: Synthetic polynucleotide"
gccttgccagcccgctcagatccatggaagtaacgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaagtaacggtcgacgaaacaccatatattttggagagggaagttggctcactgttgtaggtgagtaagtcaaggctggacagctgggaacttgcaaaaaggggctggaatccagatccatggaagtaacgctgatggcgcgagggaggc

SEQ ID NO: 3446 - DNA, 495 bp, Artificial Sequence
  source: /note="Description of Artificial Sequence: Synthetic polynucleotide"
gccttgccagcccgctcagatccatgggtctcctacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtctcctagtcgacaatgaaaaactgttttttggcagtggaacccagctctctgtcttgggtatgtaaaagacttctttcgggatagtgtatcataaggtcggagttccaggagatccatgggtctcctactgatggcgcgagggaggc

SEQ ID NO: 3447 - DNA, 495 bp, Artificial Sequence
  source: /note="Description of Artificial Sequence: Synthetic polynucleotide"
gccttgccagcccgctcagatccatggagagtgtccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggagagtgtcgtcgacatcagccccagcattttggtgatgggactcgactctccatcctaggtaagttgcagaatcagggtggtatggccattgtcccttgaaggcagagttctctatccatggagagtgtcctgatggcgcgagggaggc

SEQ ID NO: 3448 - DNA, 495 bp, Artificial Sequence
  source: /note="Description of Artificial Sequence: Synthetic polynucleotide"
gccttgccagcccgctcagatccatgggttccgaacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggttccgaagtcgacataattcacccctccactttgggaacgggaccaggctcactgtgacaggtatgggggctccactcttgactcgggggtgcctgggtttgactgcaatgatatccatgggttccgaactgatggcgcgagggaggc

SEQ ID NO: 3449 - DNA, 495 bp, Artificial Sequence
  source: /note="Description of Artificial Sequence: Synthetic polynucleotide"
gccttgccagcccgctcagatccatggcgttacttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggcgttacttgtcgacacaatgagcagttcttcgggccagggacacggctcaccgtgctaggtaagaagggggctccaggtgggagagagggtgagcagcccagcctgcacgacccatccatggcgttacttctgatggcgcgagggaggc

SEQ ID NO: 3450 - DNA, 495 bp, Artificial Sequence
  source: /note="Description of Artificial Sequence: Synthetic polynucleotide"
gccttgccagcccgctcagatccatggtaggagaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtaggagacgtcgacaccggggagctgttttttggagaaggctctaggctgaccgtactgggtaaggaggcggttggggctccggagagctccgagagggcgggatgggcagaggatccatggtaggagacctgatggcgcgagggaggc

SEQ ID NO: 3451 - DNA, 495 bp, Artificial Sequence
  source: /note="Description of Artificial Sequence: Synthetic polynucleotide"
gccttgccagcccgctcagatccatgggtgtctaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtgtctacgtcgacagatacgcagtattttggcccaggcacccggctgacagtgctcggtaagcgggggctcccgctgaagccccggaactggggagggggcgccccgggacgcatccatgggtgtctacctgatggcgcgagggaggc

SEQ ID NO: 3452 - DNA, 495 bp, Artificial Sequence
  source: /note="Description of Artificial Sequence: Synthetic polynucleotide"
gccttgccagcccgctcagatccatgggtacagtgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtacagtggtcgacaaaacattcagtacttcggcgccgggacccggctctcagtgctgggtaagctggggccgccgggggaccggggacgagactgcgctcgggtttttgtgcgatccatgggtacagtgctgatggcgcgagggaggc

SEQ ID NO: 3453 - DNA, 495 bp, Artificial Sequence
  source: /note="Description of Artificial Sequence: Synthetic polynucleotide"
gccttgccagcccgctcagatccatggggatcatccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggggatcatcgtcgacgagacccagtacttcgggccaggcacgcggctcctggtgctcggtgagcgcgggctgctggggcgcgggcgcgggcggcttgggtctggtttttgcggggatccatggggatcatcctgatggcgcgagggaggc

SEQ ID NO: 3454 - DNA, 495 bp, Artificial Sequence
  source: /note="Description of Artificial Sequence: Synthetic polynucleotide"
gccttgccagcccgctcagatccatggtattggcgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtattggcggtcgacgggccaacgtcctgactttcggggccggcagcaggctgaccgtgctgggtgagttttcgcgggaccacccgggcggcgggattcaggtggaaggcggcggatccatggtattggcgctgatggcgcgagggaggc

SEQ ID NO: 3455 - DNA, 495 bp, Artificial Sequence
  source: /note="Description of Artificial Sequence: Synthetic polynucleotide"
gccttgccagcccgctcagatccatggaggcttgacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaggcttgagtcgacacgagcagtacttcgggccgggcaccaggctcacggtcacaggtgagattcgggcgtctccccaccttccagcccctcggtccccggagtcggagggtggatccatggaggcttgactgatggcgcgagggaggc

SEQ ID NO: 3456 - DNA, 495 bp, Artificial Sequence
  source: /note="Description of Artificial Sequence: Synthetic polynucleotide"
gccttgccagcccgctcaggtagcagtgacactctctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgacactctgtcgacactgaagctttctttggacaaggcaccagactcacagttgtaggtaagacatttttcaggttcttttgcagatccgtcacagggaaaagtgggtccacaggtagcagtgacactctctgatggcgcgagggaggc

SEQ ID NO: 3457 - DNA, 495 bp, Artificial Sequence
  source: /note="Description of Artificial Sequence: Synthetic polynucleotide"
gccttgccagcccgctcaggtagcagtttcggaacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtttcggaacgtcgactatggctacaccttcggttcggggaccaggttaaccgttgtaggtaaggctgggggtctctaggaggggtgcgatgagggaggactctgtcctgggaaatgtagcagtttcggaacctgatggcgcgagggaggc

SEQ ID NO: 3458 - DNA, 495 bp, Artificial Sequence
  source: /note="Description of Artificial Sequence: Synthetic polynucleotide"
gccttgccagcccgctcaggtagcagtaagtaacgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaagtaacggtcgacgaaacaccatatattttggagagggaagttggctcactgttgtaggtgagtaagtcaaggctggacagctgggaacttgcaaaaaggggctggaatccaggtagcagtaagtaacgctgatggcgcgagggaggc

SEQ ID NO: 3459 - DNA, 495 bp, Artificial Sequence
  source: /note="Description of Artificial Sequence: Synthetic polynucleotide"
gccttgccagcccgctcaggtagcagtgtctcctactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtctcctagtcgacaatgaaaaactgttttttggcagtggaacccagctctctgtcttgggtatgtaaaagacttctttcgggatagtgtatcataaggtcggagttccaggaggtagcagtgtctcctactgatggcgcgagggaggc

SEQ ID NO: 3460 - DNA, 495 bp, Artificial Sequence
  source: /note="Description of Artificial Sequence: Synthetic polynucleotide"
gccttgccagcccgctcaggtagcagtagagtgtcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtagagtgtcgtcgacatcagccccagcattttggtgatgggactcgactctccatcctaggtaagttgcagaatcagggtggtatggccattgtcccttgaaggcagagttctctgtagcagtagagtgtcctgatggcgcgagggaggc

SEQ ID NO: 3461 - DNA, 495 bp, Artificial Sequence
  source: /note="Description of Artificial Sequence: Synthetic polynucleotide"
gccttgccagcccgctcaggtagcagtgttccgaactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgttccgaagtcgacataattcacccctccactttgggaacgggaccaggctcactgtgacaggtatgggggctccactcttgactcgggggtgcctgggtttgactgcaatgatgtagcagtgttccgaactgatggcgcgagggaggc

SEQ ID NO: 3462 - DNA, 495 bp, Artificial Sequence
  source: /note="Description of Artificial Sequence: Synthetic polynucleotide"
gccttgccagcccgctcaggtagcagtcgttacttctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtcgttacttgtcgacacaatgagcagttcttcgggccagggacacggctcaccgtgctaggtaagaagggggctccaggtgggagagagggtgagcagcccagcctgcacgacccgtagcagtcgttacttctgatggcgcgagggaggc

SEQ ID NO: 3463 - DNA, 495 bp, Artificial Sequence
  source: /note="Description of Artificial Sequence: Synthetic polynucleotide"
gccttgccagcccgctcaggtagcagttaggagacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttaggagacgtcgacaccggggagctgttttttggagaaggctctaggctgaccgtactgggtaaggaggcggttggggctccggagagctccgagagggcgggatgggcagagggtagcagttaggagacctgatggcgcgagggaggc

SEQ ID NO: 3464 - DNA, 495 bp, Artificial Sequence
  source: /note="Description of Artificial Sequence: Synthetic polynucleotide"
gccttgccagcccgctcaggtagcagtgtgtctacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtgtctacgtcgacagatacgcagtattttggcccaggcacccggctgacagtgctcggtaagcgggggctcccgctgaagccccggaactggggagggggcgccccgggacgcgtagcagtgtgtctacctgatggcgcgagggaggc

SEQ ID NO: 3465 - DNA, 495 bp, Artificial Sequence
  source: /note="Description of Artificial Sequence: Synthetic polynucleotide"
gccttgccagcccgctcaggtagcagtgtacagtgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtacagtggtcgacaaaacattcagtacttcggcgccgggacccggctctcagtgctgggtaagctggggccgccgggggaccggggacgagactgcgctcgggtttttgtgcggtagcagtgtacagtgctgatggcgcgagggaggc

SEQ ID NO: 3466 - DNA, 495 bp, Artificial Sequence
  source: /note="Description of Artificial Sequence: Synthetic polynucleotide"
gccttgccagcccgctcaggtagcagtggatcatcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtggatcatcgtcgacgagacccagtacttcgggccaggcacgcggctcctggtgctcggtgagcgcgggctgctggggcgcgggcgcgggcggcttgggtctggtttttgcgggggtagcagtggatcatcctgatggcgcgagggaggc

SEQ ID NO: 3467 - DNA, 495 bp, Artificial Sequence
  source: /note="Description of Artificial Sequence: Synthetic polynucleotide"
gccttgccagcccgctcaggtagcagttattggcgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttattggcggtcgacgggccaacgtcctgactttcggggccggcagcaggctgaccgtgctgggtgagttttcgcgggaccacccgggcggcgggattcaggtggaaggcggcgggtagcagttattggcgctgatggcgcgagggaggc

SEQ ID NO: 3468 - DNA, 495 bp, Artificial Sequence
  source: /note="Description of Artificial Sequence: Synthetic polynucleotide"
gccttgccagcccgctcaggtagcagtaggcttgactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaggcttgagtcgacacgagcagtacttcgggccgggcaccaggctcacggtcacaggtgagattcgggcgtctccccaccttccagcccctcggtccccggagtcggagggtgggtagcagtaggcttgactgatggcgcgagggaggc

SEQ ID NO: 3469 - DNA, 495 bp, Artificial Sequence
  source: /note="Description of Artificial Sequence: Synthetic polynucleotide"
gccttgccagcccgctcagatcttcgtgacactctctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgacactctgtcgacactgaagctttctttggacaaggcaccagactcacagttgtaggtaagacatttttcaggttcttttgcagatccgtcacagggaaaagtgggtccacagatcttcgtgacactctctgatggcgcgagggaggc

SEQ ID NO: 3470 - DNA, 495 bp, Artificial Sequence
  source: /note="Description of Artificial Sequence: Synthetic polynucleotide"
gccttgccagcccgctcagatcttcgtttcggaacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtttcggaacgtcgactatggctacaccttcggttcggggaccaggttaaccgttgtaggtaaggctgggggtctctaggaggggtgcgatgagggaggactctgtcctgggaaatatcttcgtttcggaacctgatggcgcgagggaggc

SEQ ID NO: 3471 - DNA, 495 bp, Artificial Sequence
  source: /note="Description of Artificial Sequence: Synthetic polynucleotide"
gccttgccagcccgctcagatcttcgtaagtaacgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaagtaacggtcgacgaaacaccatatattttggagagggaagttggctcactgttgtaggtgagtaagtcaaggctggacagctgggaacttgcaaaaaggggctggaatccagatcttcgtaagtaacgctgatggcgcgagggaggc

SEQ ID NO: 3472 - DNA, 495 bp, Artificial Sequence
  source: /note="Description of Artificial Sequence: Synthetic polynucleotide"
gccttgccagcccgctcagatcttcgtgtctcctactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtctcctagtcgacaatgaaaaactgttttttggcagtggaacccagctctctgtcttgggtatgtaaaagacttctttcgggatagtgtatcataaggtcggagttccaggagatcttcgtgtctcctactgatggcgcgagggaggc

SEQ ID NO: 3473 - DNA, 495 bp, Artificial Sequence
  source: /note="Description of Artificial Sequence: Synthetic polynucleotide"
gccttgccagcccgctcagatcttcgtagagtgtcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtagagtgtcgtcgacatcagccccagcattttggtgatgggactcgactctccatcctaggtaagttgcagaatcagggtggtatggccattgtcccttgaaggcagagttctctatcttcgtagagtgtcctgatggcgcgagggaggc

SEQ ID NO: 3474 - DNA, 495 bp, Artificial Sequence
  source: /note="Description of Artificial Sequence: Synthetic polynucleotide"
gccttgccagcccgctcagatcttcgtgttccgaactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgttccgaagtcgacataattcacccctccactttgggaacgggaccaggctcactgtgacaggtatgggggctccactcttgactcgggggtgcctgggtttgactgcaatgatatcttcgtgttccgaactgatggcgcgagggaggc

SEQ ID NO: 3475 - DNA, 495 bp, Artificial Sequence
  source: /note="Description of Artificial Sequence: Synthetic polynucleotide"
gccttgccagcccgctcagatcttcgtcgttacttctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtcgttacttgtcgacacaatgagcagttcttcgggccagggacacggctcaccgtgctaggtaagaagggggctccaggtgggagagagggtgagcagcccagcctgcacgacccatcttcgtcgttacttctgatggcgcgagggaggc

SEQ ID NO: 3476 - DNA, 495 bp, Artificial Sequence
  source: /note="Description of Artificial Sequence: Synthetic polynucleotide"
gccttgccagcccgctcagatcttcgttaggagacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttaggagacgtcgacaccggggagctgttttttggagaaggctctaggctgaccgtactgggtaaggaggcggttggggctccggagagctccgagagggcgggatgggcagaggatcttcgttaggagacctgatggcgcgagggaggc

SEQ ID NO: 3477 - DNA, 495 bp, Artificial Sequence
  source: /note="Description of Artificial Sequence: Synthetic polynucleotide"
gccttgccagcccgctcagatcttcgtgtgtctacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtgtctacgtcgacagatacgcagtattttggcccaggcacccggctgacagtgctcggtaagcgggggctcccgctgaagccccggaactggggagggggcgccccgggacgcatcttcgtgtgtctacctgatggcgcgagggaggc

SEQ ID NO: 3478 - DNA, 495 bp, Artificial Sequence
  source: /note="Description of Artificial Sequence: Synthetic polynucleotide"
gccttgccagcccgctcagatcttcgtgtacagtgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtacagtggtcgacaaaacattcagtacttcggcgccgggacccggctctcagtgctgggtaagctggggccgccgggggaccggggacgagactgcgctcgggtttttgtgcgatcttcgtgtacagtgctgatggcgcgagggaggc

SEQ ID NO: 3479 - DNA, 495 bp, Artificial Sequence
  source: /note="Description of Artificial Sequence: Synthetic polynucleotide"
gccttgccagcccgctcagatcttcgtggatcatcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtggatcatcgtcgacgagacccagtacttcgggccaggcacgcggctcctggtgctcggtgagcgcgggctgctggggcgcgggcgcgggcggcttgggtctggtttttgcggggatcttcgtggatcatcctgatggcgcgagggaggc

SEQ ID NO: 3480 - DNA, 495 bp, Artificial Sequence
  source: /note="Description of Artificial Sequence: Synthetic polynucleotide"
gccttgccagcccgctcagatcttcgttattggcgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttattggcggtcgacgggccaacgtcctgactttcggggccggcagcaggctgaccgtgctgggtgagttttcgcgggaccacccgggcggcgggattcaggtggaaggcggcggatcttcgttattggcgctgatggcgcgagggaggc

SEQ ID NO: 3481 - DNA, 495 bp, Artificial Sequence
  source: /note="Description of Artificial Sequence: Synthetic polynucleotide"
gccttgccagcccgctcagatcttcgtaggcttgactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaggcttgagtcgacacgagcagtacttcgggccgggcaccaggctcacggtcacaggtgagattcgggcgtctccccaccttccagcccctcggtccccggagtcggagggtggatcttcgtaggcttgactgatggcgcgagggaggc

SEQ ID NO: 3482 - DNA, 495 bp, Artificial Sequence
  source: /note="Description of Artificial Sequence: Synthetic polynucleotide"
gccttgccagcccgctcagtccacagtgacactctctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgacactctgtcgacactgaagctttctttggacaaggcaccagactcacagttgtaggtaagacatttttcaggttcttttgcagatccgtcacagggaaaagtgggtccacagtccacagtgacactctctgatggcgcgagggaggc

SEQ ID NO: 3483 - DNA, 495 bp, Artificial Sequence
  source: /note="Description of Artificial Sequence: Synthetic polynucleotide"
gccttgccagcccgctcagtccacagtttcggaacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtttcggaacgtcgactatggctacaccttcggttcggggaccaggttaaccgttgtaggtaaggctgggggtctctaggaggggtgcgatgagggaggactctgtcctgggaaattccacagtttcggaacctgatggcgcgagggaggc

SEQ ID NO: 3484 - DNA, 495 bp, Artificial Sequence
  source: /note="Description of Artificial Sequence: Synthetic polynucleotide"
gccttgccagcccgctcagtccacagtaagtaacgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaagtaacggtcgacgaaacaccatatattttggagagggaagttggctcactgttgtaggtgagtaagtcaaggctggacagctgggaacttgcaaaaaggggctggaatccagtccacagtaagtaacgctgatggcgcgagggaggc

SEQ ID NO: 3485 - DNA, 495 bp, Artificial Sequence
  source: /note="Description of Artificial Sequence: Synthetic polynucleotide"
gccttgccagcccgctcagtccacagtgtctcctactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtctcctagtcgacaatgaaaaactgttttttggcagtggaacccagctctctgtcttgggtatgtaaaagacttctttcgggatagtgtatcataaggtcggagttccaggagtccacagtgtctcctactgatggcgcgagggaggc

SEQ ID NO: 3486 - DNA, 495 bp, Artificial Sequence
  source: /note="Description of Artificial Sequence: Synthetic polynucleotide"
gccttgccagcccgctcagtccacagtagagtgtcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtagagtgtcgtcgacatcagccccagcattttggtgatgggactcgactctccatcctaggtaagttgcagaatcagggtggtatggccattgtcccttgaaggcagagttctcttccacagtagagtgtcctgatggcgcgagggaggc

SEQ ID NO: 3487 - DNA, 495 bp, Artificial Sequence
  source: /note="Description of Artificial Sequence: Synthetic polynucleotide"
gccttgccagcccgctcagtccacagtgttccgaactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgttccgaagtcgacataattcacccctccactttgggaacgggaccaggctcactgtgacaggtatgggggctccactcttgactcgggggtgcctgggtttgactgcaatgattccacagtgttccgaactgatggcgcgagggaggc

SEQ ID NO: 3488 - DNA, 495 bp, Artificial Sequence
  source: /note="Description of Artificial Sequence: Synthetic polynucleotide"
gccttgccagcccgctcagtccacagtcgttacttctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtcgttacttgtcgacacaatgagcagttcttcgggccagggacacggctcaccgtgctaggtaagaagggggctccaggtgggagagagggtgagcagcccagcctgcacgaccctccacagtcgttacttctgatggcgcgagggaggc

SEQ ID NO: 3489 - DNA, 495 bp, Artificial Sequence
  source: /note="Description of Artificial Sequence: Synthetic polynucleotide"
gccttgccagcccgctcagtccacagttaggagacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttaggagacgtcgacaccggggagctgttttttggagaaggctctaggctgaccgtactgggtaaggaggcggttggggctccggagagctccgagagggcgggatgggcagaggtccacagttaggagacctgatggcgcgagggaggc

SEQ ID NO: 3490 - DNA, 495 bp, Artificial Sequence
  source: /note="Description of Artificial Sequence: Synthetic polynucleotide"
gccttgccagcccgctcagtccacagtgtgtctacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtgtctacgtcgacagatacgcagtattttggcccaggcacccggctgacagtgctcggtaagcgggggctcccgctgaagccccggaactggggagggggcgccccgggacgctccacagtgtgtctacctgatggcgcgagggaggc

SEQ ID NO: 3491 - DNA, 495 bp, Artificial Sequence
  source: /note="Description of Artificial Sequence: Synthetic polynucleotide"
gccttgccagcccgctcagtccacagtgtacagtgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtacagtggtcgacaaaacattcagtacttcggcgccgggacccggctctcagtgctgggtaagctggggccgccgggggaccggggacgagactgcgctcgggtttttgtgcgtccacagtgtacagtgctgatggcgcgagggaggc

SEQ ID NO: 3492 - DNA, 495 bp, Artificial Sequence
  source: /note="Description of Artificial Sequence: Synthetic polynucleotide"
gccttgccagcccgctcagtccacagtggatcatcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtggatcatcgtcgacgagacccagtacttcgggccaggcacgcggctcctggtgctcggtgagcgcgggctgctggggcgcgggcgcgggcggcttgggtctggtttttgcggggtccacagtggatcatcctgatggcgcgagggaggc

SEQ ID NO: 3493 - DNA, 495 bp, Artificial Sequence
  source: /note="Description of Artificial Sequence: Synthetic polynucleotide"
gccttgccagcccgctcagtccacagttattggcgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttattggcggtcgacgggccaacgtcctgactttcggggccggcagcaggctgaccgtgctgggtgagttttcgcgggaccacccgggcggcgggattcaggtggaaggcggcggtccacagttattggcgctgatggcgcgagggaggc

SEQ ID NO: 3494 - DNA, 495 bp, Artificial Sequence
  source: /note="Description of Artificial Sequence: Synthetic polynucleotide"
gccttgccagcccgctcagtccacagtaggcttgactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaggcttgagtcgacacgagcagtacttcgggccgggcaccaggctcacggtcacaggtgagattcgggcgtctccccaccttccagcccctcggtccccggagtcggagggtggtccacagtaggcttgactgatggcgcgagggaggc

SEQ ID NO: 3495 - DNA, 495 bp, Artificial Sequence
  source: /note="Description of Artificial Sequence: Synthetic polynucleotide"
gccttgccagcccgctcagatgacaccgacactctttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgacactctgtcgacactgaagctttctttggacaaggcaccagactcacagttgtaggtaagacatttttcaggttcttttgcagatccgtcacagggaaaagtgggtccacagatgacaccgacactctctgatggcgcgagggaggc

SEQ ID NO: 3496 - DNA, 495 bp, Artificial Sequence
  source: /note="Description of Artificial Sequence: Synthetic polynucleotide"
gccttgccagcccgctcagatgacaccttcggaacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccttcggaacgtcgactatggctacaccttcggttcggggaccaggttaaccgttgtaggtaaggctgggggtctctaggaggggtgcgatgagggaggactctgtcctgggaaatatgacaccttcggaacctgatggcgcgagggaggc

SEQ ID NO: 3497 - DNA, 495 bp, Artificial Sequence
  source: /note="Description of Artificial Sequence: Synthetic polynucleotide"
gccttgccagcccgctcagatgacaccaagtaacgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaagtaacggtcgacgaaacaccatatattttggagagggaagttggctcactgttgtaggtgagtaagtcaaggctggacagctgggaacttgcaaaaaggggctggaatccagatgacaccaagtaacgctgatggcgcgagggaggc

SEQ ID NO: 3498 - DNA, 495 bp, Artificial Sequence
  source: /note="Description of Artificial Sequence: Synthetic polynucleotide"
gccttgccagcccgctcagatgacaccgtctcctattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtctcctagtcgacaatgaaaaactgttttttggcagtggaacccagctctctgtcttgggtatgtaaaagacttctttcgggatagtgtatcataaggtcggagttccaggagatgacaccgtctcctactgatggcgcgagggaggc

SEQ ID NO: 3499 - DNA, 495 bp, Artificial Sequence
  source: /note="Description of Artificial Sequence: Synthetic polynucleotide"
gccttgccagcccgctcagatgacaccagagtgtcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccagagtgtcgtcgacatcagccccagcattttggtgatgggactcgactctccatcctaggtaagttgcagaatcagggtggtatggccattgtcccttgaaggcagagttctctatgacaccagagtgtcctgatggcgcgagggaggc

SEQ ID NO: 3500 - DNA, 495 bp, Artificial Sequence
  source: /note="Description of Artificial Sequence: Synthetic polynucleotide"
gccttgccagcccgctcagatgacaccgttccgaattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgttccgaagtcgacataattcacccctccactttgggaacgggaccaggctcactgtgacaggtatgggggctccactcttgactcgggggtgcctgggtttgactgcaatgatatgacaccgttccgaactgatggcgcgagggaggc

SEQ ID NO: 3501 - DNA, 495 bp, Artificial Sequence
  source: /note="Description of Artificial Sequence: Synthetic polynucleotide"
gccttgccagcccgctcagatgacacccgttacttttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacccgttacttgtcgacacaatgagcagttcttcgggccagggacacggctcaccgtgctaggtaagaagggggctccaggtgggagagagggtgagcagcccagcctgcacgacccatgacacccgttacttctgatggcgcgagggaggc

SEQ ID NO: 3502 - DNA, 495 bp, Artificial Sequence
  source: /note="Description of Artificial Sequence: Synthetic polynucleotide"
gccttgccagcccgctcagatgacacctaggagacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctaggagacgtcgacaccggggagctgttttttggagaaggctctaggctgaccgtactgggtaaggaggcggttggggctccggagagctccgagagggcgggatgggcagaggatgacacctaggagacctgatggcgcgagggaggc

SEQ ID NO: 3503 - DNA, 495 bp, Artificial Sequence
  source: /note="Description of Artificial Sequence: Synthetic polynucleotide"
gccttgccagcccgctcagatgacaccgtgtctacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtgtctacgtcgacagatacgcagtattttggcccaggcacccggctgacagtgctcggtaagcgggggctcccgctgaagccccggaactggggagggggcgccccgggacgcatgacaccgtgtctacctgatggcgcgagggaggc

SEQ ID NO: 3504 - DNA, 495 bp, Artificial Sequence
  source: /note="Description of Artificial Sequence: Synthetic polynucleotide"
gccttgccagcccgctcagatgacaccgtacagtgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtacagtggtcgacaaaacattcagtacttcggcgccgggacccggctctcagtgctgggtaagctggggccgccgggggaccggggacgagactgcgctcgggtttttgtgcgatgacaccgtacagtgctgatggcgcgagggaggc

SEQ ID NO: 3505 - DNA, 495 bp, Artificial Sequence
  source: /note="Description of Artificial Sequence: Synthetic polynucleotide"
gccttgccagcccgctcagatgacaccggatcatcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccggatcatcgtcgacgagacccagtacttcgggccaggcacgcggctcctggtgctcggtgagcgcgggctgctggggcgcgggcgcgggcggcttgggtctggtttttgcggggatgacaccggatcatcctgatggcgcgagggaggc

SEQ ID NO: 3506 - DNA, 495 bp, Artificial Sequence
  source: /note="Description of Artificial Sequence: Synthetic polynucleotide"
gccttgccagcccgctcagatgacacctattggcgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctattggcggtcgacgggccaacgtcctgactttcggggccggcagcaggctgaccgtgctgggtgagttttcgcgggaccacccgggcggcgggattcaggtggaaggcggcggatgacacctattggcgctgatggcgcgagggaggc

SEQ ID NO: 3507 - DNA, 495 bp, Artificial Sequence
  source: /note="Description of Artificial Sequence: Synthetic polynucleotide"
gccttgccagcccgctcagatgacaccaggcttgattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaggcttgagtcgacacgagcagtacttcgggccgggcaccaggctcacggtcacaggtgagattcgggcgtctccccaccttccagcccctcggtccccggagtcggagggtggatgacaccaggcttgactgatggcgcgagggaggc

SEQ ID NO: 3508 - DNA, 495 bp, Artificial Sequence
  source: /note="Description of Artificial Sequence: Synthetic polynucleotide"
gccttgccagcccgctcagcttcacgagacactcttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagacactctgtcgacactgaagctttctttggacaaggcaccagactcacagttgtaggtaagacatttttcaggttcttttgcagatccgtcacagggaaaagtgggtccacagcttcacgagacactctctgatggcgcgagggaggc

SEQ ID NO: 3509 - DNA, 495 bp, Artificial Sequence
  source: /note="Description of Artificial Sequence: Synthetic polynucleotide"
gccttgccagcccgctcagcttcacgattcggaactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgattcggaacgtcgactatggctacaccttcggttcggggaccaggttaaccgttgtaggtaaggctgggggtctctaggaggggtgcgatgagggaggactctgtcctgggaaatcttcacgattcggaacctgatggcgcgagggaggc

SEQ ID NO: 3510 - DNA, 495 bp, Artificial Sequence
  source: /note="Description of Artificial Sequence: Synthetic polynucleotide"
gccttgccagcccgctcagcttcacgaaagtaacgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaagtaacggtcgacgaaacaccatatattttggagagggaagttggctcactgttgtaggtgagtaagtcaaggctggacagctgggaacttgcaaaaaggggctggaatccagcttcacgaaagtaacgctgatggcgcgagggaggc

SEQ ID NO: 3511 - DNA, 495 bp, Artificial Sequence
  source: /note="Description of Artificial Sequence: Synthetic polynucleotide"
gccttgccagcccgctcagcttcacgagtctcctatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtctcctagtcgacaatgaaaaactgttttttggcagtggaacccagctctctgtcttgggtatgtaaaagacttctttcgggatagtgtatcataaggtcggagttccaggagcttcacgagtctcctactgatggcgcgagggaggc

SEQ ID NO: 3512 - DNA, 495 bp, Artificial Sequence
  source: /note="Description of Artificial Sequence: Synthetic polynucleotide"
gccttgccagcccgctcagcttcacgaagagtgtctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaagagtgtcgtcgacatcagccccagcattttggtgatgggactcgactctccatcctaggtaagttgcagaatcagggtggtatggccattgtcccttgaaggcagagttctctcttcacgaagagtgtcctgatggcgcgagggaggc

SEQ ID NO: 3513 - DNA, 495 bp, Artificial Sequence
  source: /note="Description of Artificial Sequence: Synthetic polynucleotide"
gccttgccagcccgctcagcttcacgagttccgaatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagttccgaagtcgacataattcacccctccactttgggaacgggaccaggctcactgtgacaggtatgggggctccactcttgactcgggggtgcctgggtttgactgcaatgatcttcacgagttccgaactgatggcgcgagggaggc

SEQ ID NO: 3514 - DNA, 495 bp, Artificial Sequence
  source: /note="Description of Artificial Sequence: Synthetic polynucleotide"
gccttgccagcccgctcagcttcacgacgttactttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgacgttacttgtcgacacaatgagcagttcttcgggccagggacacggctcaccgtgctaggtaagaagggggctccaggtgggagagagggtgagcagcccagcctgcacgaccccttcacgacgttacttctgatggcgcgagggaggc

SEQ ID NO: 3515 - DNA, 495 bp, Artificial Sequence
  source: /note="Description of Artificial Sequence: Synthetic polynucleotide"
gccttgccagcccgctcagcttcacgataggagactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgataggagacgtcgacaccggggagctgttttttggagaaggctctaggctgaccgtactgggtaaggaggcggttggggctccggagagctccgagagggcgggatgggcagaggcttcacgataggagacctgatggcgcgagggaggc

SEQ ID NO: 3516 - DNA, 495 bp, Artificial Sequence
  source: /note="Description of Artificial Sequence: Synthetic polynucleotide"
gccttgccagcccgctcagcttcacgagtgtctactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtgtctacgtcgacagatacgcagtattttggcccaggcacccggctgacagtgctcggtaagcgggggctcccgctgaagccccggaactggggagggggcgccccgggacgccttcacgagtgtctacctgatggcgcgagggaggc

SEQ ID NO: 3517 - DNA, 495 bp, Artificial Sequence
  source: /note="Description of Artificial Sequence: Synthetic polynucleotide"
gccttgccagcccgctcagcttcacgagtacagtgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtacagtggtcgacaaaacattcagtacttcggcgccgggacccggctctcagtgctgggtaagctggggccgccgggggaccggggacgagactgcgctcgggtttttgtgcgcttcacgagtacagtgctgatggcgcgagggaggc

SEQ ID NO: 3518 - DNA, 495 bp, Artificial Sequence
  source: /note="Description of Artificial Sequence: Synthetic polynucleotide"
gccttgccagcccgctcagcttcacgaggatcatctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaggatcatcgtcgacgagacccagtacttcgggccaggcacgcggctcctggtgctcggtgagcgcgggctgctggggcgcgggcgcgggcggcttgggtctggtttttgcggggcttcacgaggatcatcctgatggcgcgagggaggc

SEQ ID NO: 3519 - DNA, 495 bp, Artificial Sequence
  source: /note="Description of Artificial Sequence: Synthetic polynucleotide"
gccttgccagcccgctcagcttcacgatattggcgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgatattggcggtcgacgggccaacgtcctgactttcggggccggcagcaggctgaccgtgctgggtgagttttcgcgggaccacccgggcggcgggattcaggtggaaggcggcggcttcacgatattggcgctgatggcgcgagggaggc

SEQ ID NO: 3520 - DNA, 495 bp, Artificial Sequence
  source: /note="Description of Artificial Sequence: Synthetic polynucleotide"
gccttgccagcccgctcagcttcacgaaggcttgatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaggcttgagtcgacacgagcagtacttcgggccgggcaccaggctcacggtcacaggtgagattcgggcgtctccccaccttccagcccctcggtccccggagtcggagggtggcttcacgaaggcttgactgatggcgcgagggaggc

SEQ ID NO: 3521 - DNA, 495 bp, Artificial Sequence
  source: /note="Description of Artificial Sequence: Synthetic polynucleotide"
gccttgccagcccgctcagagctagtggacactctttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggacactctgtcgacactgaagctttctttggacaaggcaccagactcacagttgtaggtaagacatttttcaggttcttttgcagatccgtcacagggaaaagtgggtccacagagctagtggacactctctgatggcgcgagggaggc

SEQ ID NO: 3522 - DNA, 495 bp, Artificial Sequence
  source: /note="Description of Artificial Sequence: Synthetic polynucleotide"
gccttgccagcccgctcagagctagtgttcggaacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgttcggaacgtcgactatggctacaccttcggttcggggaccaggttaaccgttgtaggtaaggctgggggtctctaggaggggtgcgatgagggaggactctgtcctgggaaatagctagtgttcggaacctgatggcgcgagggaggc

SEQ ID NO: 3523 - DNA, 495 bp, Artificial Sequence
  source: /note="Description of Artificial Sequence: Synthetic polynucleotide"
gccttgccagcccgctcagagctagtgaagtaacgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaagtaacggtcgacgaaacaccatatattttggagagggaagttggctcactgttgtaggtgagtaagtcaaggctggacagctgggaacttgcaaaaaggggctggaatccagagctagtgaagtaacgctgatggcgcgagggaggc

SEQ ID NO: 3524 - DNA, 495 bp, Artificial Sequence
  source: /note="Description of Artificial Sequence: Synthetic polynucleotide"
gccttgccagcccgctcagagctagtggtctcctattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtctcctagtcgacaatgaaaaactgttttttggcagtggaacccagctctctgtcttgggtatgtaaaagacttctttcgggatagtgtatcataaggtcggagttccaggagagctagtggtctcctactgatggcgcgagggaggc

SEQ ID NO: 3525 - DNA, 495 bp, Artificial Sequence
  source: /note="Description of Artificial Sequence: Synthetic polynucleotide"
gccttgccagcccgctcagagctagtgagagtgtcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgagagtgtcgtcgacatcagccccagcattttggtgatgggactcgactctccatcctaggtaagttgcagaatcagggtggtatggccattgtcccttgaaggcagagttctctagctagtgagagtgtcctgatggcgcgagggaggc

SEQ ID NO: 3526 - DNA, 495 bp, Artificial Sequence
  source: /note="Description of Artificial Sequence: Synthetic polynucleotide"
gccttgccagcccgctcagagctagtggttccgaattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggttccgaagtcgacataattcacccctccactttgggaacgggaccaggctcactgtgacaggtatgggggctccactcttgactcgggggtgcctgggtttgactgcaatgatagctagtggttccgaactgatggcgcgagggaggc

SEQ ID NO: 3527 - DNA, 495 bp, Artificial Sequence
  source: /note="Description of Artificial Sequence: Synthetic polynucleotide"
gccttgccagcccgctcagagctagtgcgttacttttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgcgttacttgtcgacacaatgagcagttcttcgggccagggacacggctcaccgtgctaggtaagaagggggctccaggtgggagagagggtgagcagcccagcctgcacgacccagctagtgcgttacttctgatggcgcgagggaggc

SEQ ID NO: 3528 - DNA, 495 bp, Artificial Sequence
  source: /note="Description of Artificial Sequence: Synthetic polynucleotide"
gccttgccagcccgctcagagctagtgtaggagacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtaggagacgtcgacaccggggagctgttttttggagaaggctctaggctgaccgtactgggtaaggaggcggttggggctccggagagctccgagagggcgggatgggcagaggagctagtgtaggagacctgatggcgcgagggaggc

SEQ ID NO: 3529 - DNA, 495 bp, Artificial Sequence
  source: /note="Description of Artificial Sequence: Synthetic polynucleotide"
gccttgccagcccgctcagagctagtggtgtctacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtgtctacgtcgacagatacgcagtattttggcccaggcacccggctgacagtgctcggtaagcgggggctcccgctgaagccccggaactggggagggggcgccccgggacgcagctagtggtgtctacctgatggcgcgagggaggc

SEQ ID NO: 3530 - DNA, 495 bp, Artificial Sequence
  source: /note="Description of Artificial Sequence: Synthetic polynucleotide"
gccttgccagcccgctcagagctagtggtacagtgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtacagtggtcgacaaaacattcagtacttcggcgccgggacccggctctcagtgctgggtaagctggggccgccgggggaccggggacgagactgcgctcgggtttttgtgcgagctagtggtacagtgctgatggcgcgagggaggc

SEQ ID NO: 3531 - DNA, 495 bp, Artificial Sequence
  source: /note="Description of Artificial Sequence: Synthetic polynucleotide"
gccttgccagcccgctcagagctagtgggatcatcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgggatcatcgtcgacgagacccagtacttcgggccaggcacgcggctcctggtgctcggtgagcgcgggctgctggggcgcgggcgcgggcggcttgggtctggtttttgcggggagctagtgggatcatcctgatggcgcgagggaggc

SEQ ID NO: 3532 - DNA, 495 bp, Artificial Sequence
  source: /note="Description of Artificial Sequence: Synthetic polynucleotide"
gccttgccagcccgctcagagctagtgtattggcgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtattggcggtcgacgggccaacgtcctgactttcggggccggcagcaggctgaccgtgctgggtgagttttcgcgggaccacccgggcggcgggattcaggtggaaggcggcggagctagtgtattggcgctgatggcgcgagggaggc

SEQ ID NO: 3533 - DNA, 495 bp, Artificial Sequence
  source: /note="Description of Artificial Sequence: Synthetic polynucleotide"
gccttgccagcccgctcagagctagtgaggcttgattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaggcttgagtcgacacgagcagtacttcgggccgggcaccaggctcacggtcacaggtgagattcgggcgtctccccaccttccagcccctcggtccccggagtcggagggtggagctagtgaggcttgactgatggcgcgagggaggc

SEQ ID NO: 3534 - DNA, 495 bp, Artificial Sequence
  source: /note="Description of Artificial Sequence: Synthetic polynucleotide"
gccttgccagcccgctcagtaaccaaggacactctttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggacactctgtcgacactgaagctttctttggacaaggcaccagactcacagttgtaggtaagacatttttcaggttcttttgcagatccgtcacagggaaaagtgggtccacagtaaccaaggacactctctgatggcgcgagggaggc

SEQ ID NO: 3535 - DNA, 495 bp, Artificial Sequence
  source: /note="Description of Artificial Sequence: Synthetic polynucleotide"
gccttgccagcccgctcagtaaccaagttcggaacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagttcggaacgtcgactatggctacaccttcggttcggggaccaggttaaccgttgtaggtaaggctgggggtctctaggaggggtgcgatgagggaggactctgtcctgggaaattaaccaagttcggaacctgatggcgcgagggaggc

SEQ ID NO: 3536 - DNA, 495 bp, Artificial Sequence
  source: /note="Description of Artificial Sequence: Synthetic polynucleotide"
gccttgccagcccgctcagtaaccaagaagtaacgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaagtaacggtcgacgaaacaccatatattttggagagggaagttggctcactgttgtaggtgagtaagtcaaggctggacagctgggaacttgcaaaaaggggctggaatccagtaaccaagaagtaacgctgatggcgcgagggaggc

SEQ ID NO: 3537 - DNA, 495 bp, Artificial Sequence
  source: /note="Description of Artificial Sequence: Synthetic polynucleotide"
gccttgccagcccgctcagtaaccaaggtctcctattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtctcctagtcgacaatgaaaaactgttttttggcagtggaacccagctctctgtcttgggtatgtaaaagacttctttcgggatagtgtatcataaggtcggagttccaggagtaaccaaggtctcctactgatggcgcgagggaggc

SEQ ID NO: 3538 - DNA, 495 bp, Artificial Sequence
  source: /note="Description of Artificial Sequence: Synthetic polynucleotide"
gccttgccagcccgctcagtaaccaagagagtgtcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagagagtgtcgtcgacatcagccccagcattttggtgatgggactcgactctccatcctaggtaagttgcagaatcagggtggtatggccattgtcccttgaaggcagagttctcttaaccaagagagtgtcctgatggcgcgagggaggc

SEQ ID NO: 3539 - DNA, 495 bp, Artificial Sequence
  source: /note="Description of Artificial Sequence: Synthetic polynucleotide"
gccttgccagcccgctcagtaaccaaggttccgaattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggttccgaagtcgacataattcacccctccactttgggaacgggaccaggctcactgtgacaggtatgggggctccactcttgactcgggggtgcctgggtttgactgcaatgattaaccaaggttccgaactgatggcgcgagggaggc

SEQ ID NO: 3540 - DNA, 495 bp, Artificial Sequence
  source: /note="Description of Artificial Sequence: Synthetic polynucleotide"
gccttgccagcccgctcagtaaccaagcgttacttttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagcgttacttgtcgacacaatgagcagttcttcgggccagggacacggctcaccgtgctaggtaagaagggggctccaggtgggagagagggtgagcagcccagcctgcacgaccctaaccaagcgttacttctgatggcgcgagggaggc

SEQ ID NO: 3541 - DNA, 495 bp, Artificial Sequence
  source: /note="Description of Artificial Sequence: Synthetic polynucleotide"
gccttgccagcccgctcagtaaccaagtaggagacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtaggagacgtcgacaccggggagctgttttttggagaaggctctaggctgaccgtactgggtaaggaggcggttggggctccggagagctccgagagggcgggatgggcagaggtaaccaagtaggagacctgatggcgcgagggaggc

SEQ ID NO: 3542 - DNA, 495 bp, Artificial Sequence
  source: /note="Description of Artificial Sequence: Synthetic polynucleotide"
gccttgccagcccgctcagtaaccaaggtgtctacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtgtctacgtcgacagatacgcagtattttggcccaggcacccggctgacagtgctcggtaagcgggggctcccgctgaagccccggaactggggagggggcgccccgggacgctaaccaaggtgtctacctgatggcgcgagggaggc

SEQ ID NO: 3543 - DNA, 495 bp, Artificial Sequence
  source: /note="Description of Artificial Sequence: Synthetic polynucleotide"
gccttgccagcccgctcagtaaccaaggtacagtgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtacagtggtcgacaaaacattcagtacttcggcgccgggacccggctctcagtgctgggtaagctggggccgccgggggaccggggacgagactgcgctcgggtttttgtgcgtaaccaaggtacagtgctgatggcgcgagggaggc

SEQ ID NO: 3544 - DNA, 495 bp, Artificial Sequence
  source: /note="Description of Artificial Sequence: Synthetic polynucleotide"
gccttgccagcccgctcagtaaccaagggatcatcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagggatcatcgtcgacgagacccagtacttcgggccaggcacgcggctcctggtgctcggtgagcgcgggctgctggggcgcgggcgcgggcggcttgggtctggtttttgcggggtaaccaagggatcatcctgatggcgcgagggaggc

SEQ ID NO: 3545 - DNA, 495 bp, Artificial Sequence
  source: /note="Description of Artificial Sequence: Synthetic polynucleotide"
gccttgccagcccgctcagtaaccaagtattggcgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtattggcggtcgacgggccaacgtcctgactttcggggccggcagcaggctgaccgtgctgggtgagttttcgcgggaccacccgggcggcgggattcaggtggaaggcggcggtaaccaagtattggcgctgatggcgcgagggaggc

SEQ ID NO: 3546 - DNA, 495 bp, Artificial Sequence
  source: /note="Description of Artificial Sequence: Synthetic polynucleotide"
gccttgccagcccgctcagtaaccaagaggcttgattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaggcttgagtcgacacgagcagtacttcgggccgggcaccaggctcacggtcacaggtgagattcgggcgtctccccaccttccagcccctcggtccccggagtcggagggtggtaaccaagaggcttgactgatggcgcgagggaggc

SEQ ID NO: 3547 - DNA, 495 bp, Artificial Sequence
  source: /note="Description of Artificial Sequence: Synthetic polynucleotide"
gccttgccagcccgctcagcaagaggtgacactctttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgacactctgtcgacactgaagctttctttggacaaggcaccagactcacagttgtaggtaagacatttttcaggttcttttgcagatccgtcacagggaaaagtgggtccacagcaagaggtgacactctctgatggcgcgagggaggc

SEQ ID NO: 3548 - DNA, 495 bp, Artificial Sequence
  source: /note="Description of Artificial Sequence: Synthetic polynucleotide"
gccttgccagcccgctcagcaagaggtttcggaacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtttcggaacgtcgactatggctacaccttcggttcggggaccaggttaaccgttgtaggtaaggctgggggtctctaggaggggtgcgatgagggaggactctgtcctgggaaatcaagaggtttcggaacctgatggcgcgagggaggc

SEQ ID NO: 3549 - DNA, 495 bp, Artificial Sequence
  source: /note="Description of Artificial Sequence: Synthetic polynucleotide"
gccttgccagcccgctcagcaagaggtaagtaacgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaagtaacggtcgacgaaacaccatatattttggagagggaagttggctcactgttgtaggtgagtaagtcaaggctggacagctgggaacttgcaaaaaggggctggaatccagcaagaggtaagtaacgctgatggcgcgagggaggc

SEQ ID NO: 3550 - DNA, 495 bp, Artificial Sequence
  source: /note="Description of Artificial Sequence: Synthetic polynucleotide"
gccttgccagcccgctcagcaagaggtgtctcctattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtctcctagtcgacaatgaaaaactgttttttggcagtggaacccagctctctgtcttgggtatgtaaaagacttctttcgggatagtgtatcataaggtcggagttccaggagcaagaggtgtctcctactgatggcgcgagggaggc

SEQ ID NO: 3551 - DNA, 495 bp, Artificial Sequence
  source: /note="Description of Artificial Sequence: Synthetic polynucleotide"
gccttgccagcccgctcagcaagaggtagagtgtcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtagagtgtcgtcgacatcagccccagcattttggtgatgggactcgactctccatcctaggtaagttgcagaatcagggtggtatggccattgtcccttgaaggcagagttctctcaagaggtagagtgtcctgatggcgcgagggaggc

SEQ ID NO: 3552 - DNA, 495 bp, Artificial Sequence
  source: /note="Description of Artificial Sequence: Synthetic polynucleotide"
gccttgccagcccgctcagcaagaggtgttccgaattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgttccgaagtcgacataattcacccctccactttgggaacgggaccaggctcactgtgacaggtatgggggctccactcttgactcgggggtgcctgggtttgactgcaatgatcaagaggtgttccgaactgatggcgcgagggaggc

SEQ ID NO: 3553 - DNA, 495 bp, Artificial Sequence
  source: /note="Description of Artificial Sequence: Synthetic polynucleotide"
gccttgccagcccgctcagcaagaggtcgttacttttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtcgttacttgtcgacacaatgagcagttcttcgggccagggacacggctcaccgtgctaggtaagaagggggctccaggtgggagagagggtgagcagcccagcctgcacgaccccaagaggtcgttacttctgatggcgcgagggaggc

SEQ ID NO: 3554 - DNA, 495 bp, Artificial Sequence
  source: /note="Description of Artificial Sequence: Synthetic polynucleotide"
gccttgccagcccgctcagcaagaggttaggagacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttaggagacgtcgacaccggggagctgttttttggagaaggctctaggctgaccgtactgggtaaggaggcggttggggctccggagagctccgagagggcgggatgggcagaggcaagaggttaggagacctgatggcgcgagggaggc

SEQ ID NO: 3555 - DNA, 495 bp, Artificial Sequence
  source: /note="Description of Artificial Sequence: Synthetic polynucleotide"
gccttgccagcccgctcagcaagaggtgtgtctacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtgtctacgtcgacagatacgcagtattttggcccaggcacccggctgacagtgctcggtaagcgggggctcccgctgaagccccggaactggggagggggcgccccgggacgccaagaggtgtgtctacctgatggcgcgagggaggc

SEQ ID NO: 3556 - DNA, 495 bp, Artificial Sequence
  source: /note="Description of Artificial Sequence: Synthetic polynucleotide"
gccttgccagcccgctcagcaagaggtgtacagtgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtacagtggtcgacaaaacattcagtacttcggcgccgggacccggctctcagtgctgggtaagctggggccgccgggggaccggggacgagactgcgctcgggtttttgtgcgcaagaggtgtacagtgctgatggcgcgagggaggc

SEQ ID NO: 3557 - DNA, 495 bp, Artificial Sequence
  source: /note="Description of Artificial Sequence: Synthetic polynucleotide"
gccttgccagcccgctcagcaagaggtggatcatcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtggatcatcgtcgacgagacccagtacttcgggccaggcacgcggctcctggtgctcggtgagcgcgggctgctggggcgcgggcgcgggcggcttgggtctggtttttgcggggcaagaggtggatcatcctgatggcgcgagggaggc

SEQ ID NO: 3558 - DNA, 495 bp, Artificial Sequence
  source: /note="Description of Artificial Sequence: Synthetic polynucleotide"
gccttgccagcccgctcagcaagaggttattggcgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttattggcggtcgacgggccaacgtcctgactttcggggccggcagcaggctgaccgtgctgggtgagttttcgcgggaccacccgggcggcgggattcaggtggaaggcggcggcaagaggttattggcgctgatggcgcgagggaggc

SEQ ID NO: 3559 - DNA, 495 bp, Artificial Sequence
  source: /note="Description of Artificial Sequence: Synthetic polynucleotide"
gccttgccagcccgctcagcaagaggtaggcttgattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaggcttgagtcgacacgagcagtacttcgggccgggcaccaggctcacggtcacaggtgagattcgggcgtctccccaccttccagcccctcggtccccggagtcggagggtggcaagaggtaggcttgactgatggcgcgagggaggc

SEQ ID NO: 3560 - DNA, 495 bp, Artificial Sequence
  source: /note="Description of Artificial Sequence: Synthetic polynucleotide"
gccttgccagcccgctcagagaatcaggacactctctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggacactctgtcgacactgaagctttctttggacaaggcaccagactcacagttgtaggtaagacatttttcaggttcttttgcagatccgtcacagggaaaagtgggtccacagagaatcaggacactctctgatggcgcgagggaggc

SEQ ID NO: 3561 - DNA, 495 bp, Artificial Sequence
  source: /note="Description of Artificial Sequence: Synthetic polynucleotide"
gccttgccagcccgctcagagaatcagttcggaacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagttcggaacgtcgactatggctacaccttcggttcggggaccaggttaaccgttgtaggtaaggctgggggtctctaggaggggtgcgatgagggaggactctgtcctgggaaatagaatcagttcggaacctgatggcgcgagggaggc

SEQ ID NO: 3562 - DNA, 495 bp, Artificial Sequence
  source: /note="Description of Artificial Sequence: Synthetic polynucleotide"
gccttgccagcccgctcagagaatcagaagtaacgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaagtaacggtcgacgaaacaccatatattttggagagggaagttggctcactgttgtaggtgagtaagtcaaggctggacagctgggaacttgcaaaaaggggctggaatccagagaatcagaagtaacgctgatggcgcgagggaggc

SEQ ID NO: 3563 - DNA, 495 bp, Artificial Sequence
  source: /note="Description of Artificial Sequence: Synthetic polynucleotide"
gccttgccagcccgctcagagaatcaggtctcctactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtctcctagtcgacaatgaaaaactgttttttggcagtggaacccagctctctgtcttgggtatgtaaaagacttctttcgggatagtgtatcataaggtcggagttccaggagagaatcaggtctcctactgatggcgcgagggaggc

SEQ ID NO: 3564 - DNA, 495 bp, Artificial Sequence
  source: /note="Description of Artificial Sequence: Synthetic polynucleotide"
gccttgccagcccgctcagagaatcagagagtgtcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagagagtgtcgtcgacatcagccccagcattttggtgatgggactcgactctccatcctaggtaagttgcagaatcagggtggtatggccattgtcccttgaaggcagagttctctagaatcagagagtgtcctgatggcgcgagggaggc

SEQ ID NO: 3565 - DNA, 495 bp, Artificial Sequence
  source: /note="Description of Artificial Sequence: Synthetic polynucleotide"
gccttgccagcccgctcagagaatcaggttccgaactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggttccgaagtcgacataattcacccctccactttgggaacgggaccaggctcactgtgacaggtatgggggctccactcttgactcgggggtgcctgggtttgactgcaatgatagaatcaggttccgaactgatggcgcgagggaggc

SEQ ID NO: 3566 - DNA, 495 bp, Artificial Sequence
  source: /note="Description of Artificial Sequence: Synthetic polynucleotide"
gccttgccagcccgctcagagaatcagcgttacttctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagcgttacttgtcgacacaatgagcagttcttcgggccagggacacggctcaccgtgctaggtaagaagggggctccaggtgggagagagggtgagcagcccagcctgcacgacccagaatcagcgttacttctgatggcgcgagggaggc

SEQ ID NO: 3567 - DNA, 495 bp, Artificial Sequence
  source: /note="Description of Artificial Sequence: Synthetic polynucleotide"
gccttgccagcccgctcagagaatcagtaggagacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtaggagacgtcgacaccggggagctgttttttggagaaggctctaggctgaccgtactgggtaaggaggcggttggggctccggagagctccgagagggcgggatgggcagaggagaatcagtaggagacctgatggcgcgagggaggc

SEQ ID NO: 3568 - DNA, 495 bp, Artificial Sequence
  source: /note="Description of Artificial Sequence: Synthetic polynucleotide"
gccttgccagcccgctcagagaatcaggtgtctacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtgtctacgtcgacagatacgcagtattttggcccaggcacccggctgacagtgctcggtaagcgggggctcccgctgaagccccggaactggggagggggcgccccgggacgcagaatcaggtgtctacctgatggcgcgagggaggc

SEQ ID NO: 3569 - DNA, 495 bp, Artificial Sequence
  source: /note="Description of Artificial Sequence: Synthetic polynucleotide"
gccttgccagcccgctcagagaatcaggtacagtgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtacagtggtcgacaaaacattcagtacttcggcgccgggacccggctctcagtgctgggtaagctggggccgccgggggaccggggacgagactgcgctcgggtttttgtgcgagaatcaggtacagtgctgatggcgcgagggaggc

SEQ ID NO: 3570 - DNA, 495 bp, Artificial Sequence
  source: /note="Description of Artificial Sequence: Synthetic polynucleotide"
gccttgccagcccgctcagagaatcagggatcatcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagggatcatcgtcgacgagacccagtacttcgggccaggcacgcggctcctggtgctcggtgagcgcgggctgctggggcgcgggcgcgggcggcttgggtctggtttttgcggggagaatcagggatcatcctgatggcgcgagggaggc

SEQ ID NO: 3571 - DNA, 495 bp, Artificial Sequence
  source: /note="Description of Artificial Sequence: Synthetic polynucleotide"
gccttgccagcccgctcagagaatcagtattggcgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtattggcggtcgacgggccaacgtcctgactttcggggccggcagcaggctgaccgtgctgggtgagttttcgcgggaccacccgggcggcgggattcaggtggaaggcggcggagaatcagtattggcgctgatggcgcgagggaggc

SEQ ID NO: 3572 - DNA, 495 bp, Artificial Sequence
  source: /note="Description of Artificial Sequence: Synthetic polynucleotide"
gccttgccagcccgctcagagaatcagaggcttgactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaggcttgagtcgacacgagcagtacttcgggccgggcaccaggctcacggtcacaggtgagattcgggcgtctccccaccttccagcccctcggtccccggagtcggagggtggagaatcagaggcttgactgatggcgcgagggaggc

SEQ ID NO: 3573 - DNA, 495 bp, Artificial Sequence
  source: /note="Description of Artificial Sequence: Synthetic polynucleotide"
gccttgccagcccgctcagagttgaccgacactctctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgacactctgtcgacactgaagctttctttggacaaggcaccagactcacagttgtaggtaagacatttttcaggttcttttgcagatccgtcacagggaaaagtgggtccacagagttgaccgacactctctgatggcgcgagggaggc

SEQ ID NO: 3574 - DNA, 495 bp, Artificial Sequence
  source: /note="Description of Artificial Sequence: Synthetic polynucleotide"
gccttgccagcccgctcagagttgaccttcggaacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccttcggaacgtcgactatggctacaccttcggttcggggaccaggttaaccgttgtaggtaaggctgggggtctctaggaggggtgcgatgagggaggactctgtcctgggaaatagttgaccttcggaacctgatggcgcgagggaggc

SEQ ID NO: 3575 - DNA, 495 bp, Artificial Sequence
  source: /note="Description of Artificial Sequence: Synthetic polynucleotide"
gccttgccagcccgctcagagttgaccaagtaacgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaagtaacggtcgacgaaacaccatatattttggagagggaagttggctcactgttgtaggtgagtaagtcaaggctggacagctgggaacttgcaaaaaggggctggaatccagagttgaccaagtaacgctgatggcgcgagggaggc

SEQ ID NO: 3576 - DNA, 495 bp, Artificial Sequence
  source: /note="Description of Artificial Sequence: Synthetic polynucleotide"
gccttgccagcccgctcagagttgaccgtctcctactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtctcctagtcgacaatgaaaaactgttttttggcagtggaacccagctctctgtcttgggtatgtaaaagacttctttcgggatagtgtatcataaggtcggagttccaggagagttgaccgtctcctactgatggcgcgagggaggc

SEQ ID NO: 3577 - DNA, 495 bp, Artificial Sequence
  source: /note="Description of Artificial Sequence: Synthetic polynucleotide"
gccttgccagcccgctcagagttgaccagagtgtcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccagagtgtcgtcgacatcagccccagcattttggtgatgggactcgactctccatcctaggtaagttgcagaatcagggtggtatggccattgtcccttgaaggcagagttctctagttgaccagagtgtcctgatggcgcgagggaggc

SEQ ID NO: 3578 - DNA, 495 bp, Artificial Sequence
  source: /note="Description of Artificial Sequence: Synthetic polynucleotide"
gccttgccagcccgctcagagttgaccgttccgaactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgttccgaagtcgacataattcacccctccactttgggaacgggaccaggctcactgtgacaggtatgggggctccactcttgactcgggggtgcctgggtttgactgcaatgatagttgaccgttccgaactgatggcgcgagggaggc

SEQ ID NO: 3579 - DNA, 495 bp, Artificial Sequence
  source: /note="Description of Artificial Sequence: Synthetic polynucleotide"
gccttgccagcccgctcagagttgacccgttacttctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacccgttacttgtcgacacaatgagcagttcttcgggccagggacacggctcaccgtgctaggtaagaagggggctccaggtgggagagagggtgagcagcccagcctgcacgacccagttgacccgttacttctgatggcgcgagggaggc

SEQ ID NO: 3580 - DNA, 495 bp, Artificial Sequence
  source: /note="Description of Artificial Sequence: Synthetic polynucleotide"
gccttgccagcccgctcagagttgacctaggagacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctaggagacgtcgacaccggggagctgttttttggagaaggctctaggctgaccgtactgggtaaggaggcggttggggctccggagagctccgagagggcgggatgggcagaggagttgacctaggagacctgatggcgcgagggaggc

SEQ ID NO: 3581 - DNA, 495 bp, Artificial Sequence
  source: /note="Description of Artificial Sequence: Synthetic polynucleotide"
gccttgccagcccgctcagagttgaccgtgtctacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtgtctacgtcgacagatacgcagtattttggcccaggcacccggctgacagtgctcggtaagcgggggctcccgctgaagccccggaactggggagggggcgccccgggacgcagttgaccgtgtctacctgatggcgcgagggaggc

SEQ ID NO: 3582 - DNA, 495 bp, Artificial Sequence
  source: /note="Description of Artificial Sequence: Synthetic polynucleotide"
gccttgccagcccgctcagagttgaccgtacagtgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtacagtggtcgacaaaacattcagtacttcggcgccgggacccggctctcagtgctgggtaagctggggccgccgggggaccggggacgagactgcgctcgggtttttgtgcgagttgaccgtacagtgctgatggcgcgagggaggc

SEQ ID NO: 3583 - DNA, 495 bp, Artificial Sequence
  source: /note="Description of Artificial Sequence: Synthetic polynucleotide"
gccttgccagcccgctcagagttgaccggatcatcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccggatcatcgtcgacgagacccagtacttcgggccaggcacgcggctcctggtgctcggtgagcgcgggctgctggggcgcgggcgcgggcggcttgggtctggtttttgcggggagttgaccggatcatcctgatggcgcgagggaggc

SEQ ID NO: 3584 - DNA, 495 bp, Artificial Sequence
  source: /note="Description of Artificial Sequence: Synthetic polynucleotide"
gccttgccagcccgctcagagttgacctattggcgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctattggcggtcgacgggccaacgtcctgactttcggggccggcagcaggctgaccgtgctgggtgagttttcgcgggaccacccgggcggcgggattcaggtggaaggcggcggagttgacctattggcgctgatggcgcgagggaggc

SEQ ID NO: 3585 - DNA, 495 bp, Artificial Sequence
  source: /note="Description of Artificial Sequence: Synthetic polynucleotide"
gccttgccagcccgctcagagttgaccaggcttgactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaggcttgagtcgacacgagcagtacttcgggccgggcaccaggctcacggtcacaggtgagattcgggcgtctccccaccttccagcccctcggtccccggagtcggagggtggagttgaccaggcttgactgatggcgcgagggaggc

SEQ ID NO: 3586 - DNA, 495 bp, Artificial Sequence
  source: /note="Description of Artificial Sequence: Synthetic polynucleotide"
gccttgccagcccgctcagcgtacgtagacactctttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagacactctgtcgacactgaagctttctttggacaaggcaccagactcacagttgtaggtaagacatttttcaggttcttttgcagatccgtcacagggaaaagtgggtccacagcgtacgtagacactctctgatggcgcgagggaggc

SEQ ID NO: 3587 - DNA, 495 bp, Artificial Sequence
  source: /note="Description of Artificial Sequence: Synthetic polynucleotide"
gccttgccagcccgctcagcgtacgtattcggaacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtattcggaacgtcgactatggctacaccttcggttcggggaccaggttaaccgttgtaggtaaggctgggggtctctaggaggggtgcgatgagggaggactctgtcctgggaaatcgtacgtattcggaacctgatggcgcgagggaggc

SEQ ID NO: 3588 - DNA, 495 bp, Artificial Sequence
  source: /note="Description of Artificial Sequence: Synthetic polynucleotide"
gccttgccagcccgctcagcgtacgtaaagtaacgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaagtaacggtcgacgaaacaccatatattttggagagggaagttggctcactgttgtaggtgagtaagtcaaggctggacagctgggaacttgcaaaaaggggctggaatccagcgtacgtaaagtaacgctgatggcgcgagggaggc

SEQ ID NO: 3589 - DNA, 495 bp, Artificial Sequence
  source: /note="Description of Artificial Sequence: Synthetic polynucleotide"
gccttgccagcccgctcagcgtacgtagtctcctattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtctcctagtcgacaatgaaaaactgttttttggcagtggaacccagctctctgtcttgggtatgtaaaagacttctttcgggatagtgtatcataaggtcggagttccaggagcgtacgtagtctcctactgatggcgcgagggaggc

SEQ ID NO: 3590 - DNA, 495 bp, Artificial Sequence
  source: /note="Description of Artificial Sequence: Synthetic polynucleotide"
gccttgccagcccgctcagcgtacgtaagagtgtcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaagagtgtcgtcgacatcagccccagcattttggtgatgggactcgactctccatcctaggtaagttgcagaatcagggtggtatggccattgtcccttgaaggcagagttctctcgtacgtaagagtgtcctgatggcgcgagggaggc

SEQ ID NO: 3591 - DNA, 495 bp, Artificial Sequence
  source: /note="Description of Artificial Sequence: Synthetic polynucleotide"
gccttgccagcccgctcagcgtacgtagttccgaattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagttccgaagtcgacataattcacccctccactttgggaacgggaccaggctcactgtgacaggtatgggggctccactcttgactcgggggtgcctgggtttgactgcaatgatcgtacgtagttccgaactgatggcgcgagggaggc

SEQ ID NO: 3592 - DNA, 495 bp, Artificial Sequence
  source: /note="Description of Artificial Sequence: Synthetic polynucleotide"
gccttgccagcccgctcagcgtacgtacgttacttttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtacgttacttgtcgacacaatgagcagttcttcgggccagggacacggctcaccgtgctaggtaagaagggggctccaggtgggagagagggtgagcagcccagcctgcacgaccccgtacgtacgttacttctgatggcgcgagggaggc

SEQ ID NO: 3593 - DNA, 495 bp, Artificial Sequence
  source: /note="Description of Artificial Sequence: Synthetic polynucleotide"
gccttgccagcccgctcagcgtacgtataggagacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtataggagacgtcgacaccggggagctgttttttggagaaggctctaggctgaccgtactgggtaaggaggcggttggggctccggagagctccgagagggcgggatgggcagaggcgtacgtataggagacctgatggcgcgagggaggc

SEQ ID NO: 3594 - DNA, 495 bp, Artificial Sequence
  source: /note="Description of Artificial Sequence: Synthetic polynucleotide"
gccttgccagcccgctcagcgtacgtagtgtctacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtgtctacgtcgacagatacgcagtattttggcccaggcacccggctgacagtgctcggtaagcgggggctcccgctgaagccccggaactggggagggggcgccccgggacgccgtacgtagtgtctacctgatggcgcgagggaggc

SEQ ID NO: 3595 - DNA, 495 bp, Artificial Sequence
  source: /note="Description of Artificial Sequence: Synthetic polynucleotide"
gccttgccagcccgctcagcgtacgtagtacagtgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtacagtggtcgacaaaacattcagtacttcggcgccgggacccggctctcagtgctgggtaagctggggccgccgggggaccggggacgagactgcgctcgggtttttgtgcgcgtacgtagtacagtgctgatggcgcgagggaggc

SEQ ID NO: 3596 - DNA, 495 bp, Artificial Sequence
  source: /note="Description of Artificial Sequence: Synthetic polynucleotide"
gccttgccagcccgctcagcgtacgtaggatcatcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaggatcatcgtcgacgagacccagtacttcgggccaggcacgcggctcctggtgctcggtgagcgcgggctgctggggcgcgggcgcgggcggcttgggtctggtttttgcggggcgtacgtaggatcatcctgatggcgcgagggaggc

SEQ ID NO: 3597 - DNA, 495 bp, Artificial Sequence
  source: /note="Description of Artificial Sequence: Synthetic polynucleotide"
gccttgccagcccgctcagcgtacgtatattggcgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtatattggcggtcgacgggccaacgtcctgactttcggggccggcagcaggctgaccgtgctgggtgagttttcgcgggaccacccgggcggcgggattcaggtggaaggcggcggcgtacgtatattggcgctgatggcgcgagggaggc

SEQ ID NO: 3598 - DNA, 495 bp, Artificial Sequence
  source: /note="Description of Artificial Sequence: Synthetic polynucleotide"
gccttgccagcccgctcagcgtacgtaaggcttgattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaggcttgagtcgacacgagcagtacttcgggccgggcaccaggctcacggtcacaggtgagattcgggcgtctccccaccttccagcccctcggtccccggagtcggagggtggcgtacgtaaggcttgactgatggcgcgagggaggc

SEQ ID NO: 3599 - DNA, 495 bp, Artificial Sequence
  source: /note="Description of Artificial Sequence: Synthetic polynucleotide"
gccttgccagcccgctcagtcggtactgacactcttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgacactctgtcgacactgaagctttctttggacaaggcaccagactcacagttgtaggtaagacatttttcaggttcttttgcagatccgtcacagggaaaagtgggtccacagtcggtactgacactctctgatggcgcgagggaggc

SEQ ID NO: 3600 - DNA, 495 bp, Artificial Sequence
  source: /note="Description of Artificial Sequence: Synthetic polynucleotide"
gccttgccagcccgctcagtcggtactttcggaactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactttcggaacgtcgactatggctacaccttcggttcggggaccaggttaaccgttgtaggtaaggctgggggtctctaggaggggtgcgatgagggaggactctgtcctgggaaattcggtactttcggaacctgatggcgcgagggaggc

SEQ ID NO: 3601 - DNA, 495 bp, Artificial Sequence
  source: /note="Description of Artificial Sequence: Synthetic polynucleotide"
gccttgccagcccgctcagtcggtactaagtaacgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaagtaacggtcgacgaaacaccatatattttggagagggaagttggctcactgttgtaggtgagtaagtcaaggctggacagctgggaacttgcaaaaaggggctggaatccagtcggtactaagtaacgctgatggcgcgagggaggc

SEQ ID NO: 3602 - DNA, 495 bp, Artificial Sequence
  source: /note="Description of Artificial Sequence: Synthetic polynucleotide"
gccttgccagcccgctcagtcggtactgtctcctatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtctcctagtcgacaatgaaaaactgttttttggcagtggaacccagctctctgtcttgggtatgtaaaagacttctttcgggatagtgtatcataaggtcggagttccaggagtcggtactgtctcctactgatggcgcgagggaggc

SEQ ID NO: 3603 - DNA, 495 bp, Artificial Sequence
  source: /note="Description of Artificial Sequence: Synthetic polynucleotide"
gccttgccagcccgctcagtcggtactagagtgtctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactagagtgtcgtcgacatcagccccagcattttggtgatgggactcgactctccatcctaggtaagttgcagaatcagggtggtatggccattgtcccttgaaggcagagttctcttcggtactagagtgtcctgatggcgcgagggaggc

SEQ ID NO: 3604 - DNA, 495 bp, Artificial Sequence
  source: /note="Description of Artificial Sequence: Synthetic polynucleotide"
gccttgccagcccgctcagtcggtactgttccgaatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgttccgaagtcgacataattcacccctccactttgggaacgggaccaggctcactgtgacaggtatgggggctccactcttgactcgggggtgcctgggtttgactgcaatgattcggtactgttccgaactgatggcgcgagggaggc

SEQ ID NO: 3605 - DNA, 495 bp, Artificial Sequence
  source: /note="Description of Artificial Sequence: Synthetic polynucleotide"
gccttgccagcccgctcagtcggtactcgttactttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactcgttacttgtcgacacaatgagcagttcttcgggccagggacacggctcaccgtgctaggtaagaagggggctccaggtgggagagagggtgagcagcccagcctgcacgaccctcggtactcgttacttctgatggcgcgagggaggc

SEQ ID NO: 3606 - DNA, 495 bp, Artificial Sequence
  source: /note="Description of Artificial Sequence: Synthetic polynucleotide"
gccttgccagcccgctcagtcggtacttaggagactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttaggagacgtcgacaccggggagctgttttttggagaaggctctaggctgaccgtactgggtaaggaggcggttggggctccggagagctccgagagggcgggatgggcagaggtcggtacttaggagacctgatggcgcgagggaggc

SEQ ID NO: 3607 - DNA, 495 bp, Artificial Sequence
  source: /note="Description of Artificial Sequence: Synthetic polynucleotide"
gccttgccagcccgctcagtcggtactgtgtctactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtgtctacgtcgacagatacgcagtattttggcccaggcacccggctgacagtgctcggtaagcgggggctcccgctgaagccccggaactggggagggggcgccccgggacgctcggtactgtgtctacctgatggcgcgagggaggc

SEQ ID NO: 3608 - DNA, 495 bp, Artificial Sequence
  source: /note="Description of Artificial Sequence: Synthetic polynucleotide"
gccttgccagcccgctcagtcggtactgtacagtgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtacagtggtcgacaaaacattcagtacttcggcgccgggacccggctctcagtgctgggtaagctggggccgccgggggaccggggacgagactgcgctcgggtttttgtgcgtcggtactgtacagtgctgatggcgcgagggaggc

SEQ ID NO: 3609 - DNA, 495 bp, Artificial Sequence
  source: /note="Description of Artificial Sequence: Synthetic polynucleotide"
gccttgccagcccgctcagtcggtactggatcatctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactggatcatcgtcgacgagacccagtacttcgggccaggcacgcggctcctggtgctcggtgagcgcgggctgctggggcgcgggcgcgggcggcttgggtctggtttttgcggggtcggtactggatcatcctgatggcgcgagggaggc

SEQ ID NO: 3610 - DNA, 495 bp, Artificial Sequence
  source: /note="Description of Artificial Sequence: Synthetic polynucleotide"
gccttgccagcccgctcagtcggtacttattggcgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttattggcggtcgacgggccaacgtcctgactttcggggccggcagcaggctgaccgtgctgggtgagttttcgcgggaccacccgggcggcgggattcaggtggaaggcggcggtcggtacttattggcgctgatggcgcgagggaggc

SEQ ID NO: 3611 - DNA, 495 bp, Artificial Sequence
  source: /note="Description of Artificial Sequence: Synthetic polynucleotide"
gccttgccagcccgctcagtcggtactaggcttgatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaggcttgagtcgacacgagcagtacttcgggccgggcaccaggctcacggtcacaggtgagattcgggcgtctccccaccttccagcccctcggtccccggagtcggagggtggtcggtactaggcttgactgatggcgcgagggaggc

SEQ ID NO: 3612 - DNA, 495 bp, Artificial Sequence
  source: /note="Description of Artificial Sequence: Synthetic polynucleotide"
gccttgccagcccgctcagccatggatgacactctctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgacactctgtcgacactgaagctttctttggacaaggcaccagactcacagttgtaggtaagacatttttcaggttcttttgcagatccgtcacagggaaaagtgggtccacagccatggatgacactctctgatggcgcgagggaggc

SEQ ID NO: 3613 - DNA, 495 bp, Artificial Sequence
  source: /note="Description of Artificial Sequence: Synthetic polynucleotide"
gccttgccagcccgctcagccatggatttcggaacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatttcggaacgtcgactatggctacaccttcggttcggggaccaggttaaccgttgtaggtaaggctgggggtctctaggaggggtgcgatgagggaggactctgtcctgggaaatccatggatttcggaacctgatggcgcgagggaggc

SEQ ID NO: 3614 - DNA, 495 bp, Artificial Sequence
  source: /note="Description of Artificial Sequence: Synthetic polynucleotide"
gccttgccagcccgctcagccatggataagtaacgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataagtaacggtcgacgaaacaccatatattttggagagggaagttggctcactgttgtaggtgagtaagtcaaggctggacagctgggaacttgcaaaaaggggctggaatccagccatggataagtaacgctgatggcgcgagggaggc

SEQ ID NO: 3615 - DNA, 495 bp, Artificial Sequence
  source: /note="Description of Artificial Sequence: Synthetic polynucleotide"
gccttgccagcccgctcagccatggatgtctcctactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtctcctagtcgacaatgaaaaactgttttttggcagtggaacccagctctctgtcttgggtatgtaaaagacttctttcgggatagtgtatcataaggtcggagttccaggagccatggatgtctcctactgatggcgcgagggaggc

SEQ ID NO: 3616 - DNA, 495 bp, Artificial Sequence
  source: /note="Description of Artificial Sequence: Synthetic polynucleotide"
gccttgccagcccgctcagccatggatagagtgtcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatagagtgtcgtcgacatcagccccagcattttggtgatgggactcgactctccatcctaggtaagttgcagaatcagggtggtatggccattgtcccttgaaggcagagttctctccatggatagagtgtcctgatggcgcgagggaggc

SEQ ID NO: 3617 - DNA, 495 bp, Artificial Sequence
  source: /note="Description of Artificial Sequence: Synthetic polynucleotide"
gccttgccagcccgctcagccatggatgttccgaactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgttccgaagtcgacataattcacccctccactttgggaacgggaccaggctcactgtgacaggtatgggggctccactcttgactcgggggtgcctgggtttgactgcaatgatccatggatgttccgaactgatggcgcgagggaggc

SEQ ID NO: 3618 - DNA, 495 bp, Artificial Sequence
  source: /note="Description of Artificial Sequence: Synthetic polynucleotide"
gccttgccagcccgctcagccatggatcgttacttctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatcgttacttgtcgacacaatgagcagttcttcgggccagggacacggctcaccgtgctaggtaagaagggggctccaggtgggagagagggtgagcagcccagcctgcacgacccccatggatcgttacttctgatggcgcgagggaggc

SEQ ID NO: 3619 - DNA, 495 bp, Artificial Sequence
  source: /note="Description of Artificial Sequence: Synthetic polynucleotide"
gccttgccagcccgctcagccatggattaggagacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattaggagacgtcgacaccggggagctgttttttggagaaggctctaggctgaccgtactgggtaaggaggcggttggggctccggagagctccgagagggcgggatgggcagaggccatggattaggagacctgatggcgcgagggaggc

SEQ ID NO: 3620 - DNA, 495 bp, Artificial Sequence
  source: /note="Description of Artificial Sequence: Synthetic polynucleotide"
gccttgccagcccgctcagccatggatgtgtctacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtgtctacgtcgacagatacgcagtattttggcccaggcacccggctgacagtgctcggtaagcgggggctcccgctgaagccccggaactggggagggggcgccccgggacgcccatggatgtgtctacctgatggcgcgagggaggc

SEQ ID NO: 3621 - DNA, 495 bp, Artificial Sequence
  source: /note="Description of Artificial Sequence: Synthetic polynucleotide"
gccttgccagcccgctcagccatggatgtacagtgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtacagtggtcgacaaaacattcagtacttcggcgccgggacccggctctcagtgctgggtaagctggggccgccgggggaccggggacgagactgcgctcgggtttttgtgcgccatggatgtacagtgctgatggcgcgagggaggc

SEQ ID NO: 3622 - DNA, 495 bp, Artificial Sequence
  source: /note="Description of Artificial Sequence: Synthetic polynucleotide"
gccttgccagcccgctcagccatggatggatcatcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatggatcatcgtcgacgagacccagtacttcgggccaggcacgcggctcctggtgctcggtgagcgcgggctgctggggcgcgggcgcgggcggcttgggtctggtttttgcggggccatggatggatcatcctgatggcgcgagggaggc

SEQ ID NO: 3623 - DNA, 495 bp, Artificial Sequence
  source: /note="Description of Artificial Sequence: Synthetic polynucleotide"
gccttgccagcccgctcagccatggattattggcgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattattggcggtcgacgggccaacgtcctgactttcggggccggcagcaggctgaccgtgctgggtgagttttcgcgggaccacccgggcggcgggattcaggtggaaggcggcggccatggattattggcgctgatggcgcgagggaggc

SEQ ID NO: 3624 - DNA, 495 bp, Artificial Sequence
  source: /note="Description of Artificial Sequence: Synthetic polynucleotide"
gccttgccagcccgctcagccatggataggcttgactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataggcttgagtcgacacgagcagtacttcgggccgggcaccaggctcacggtcacaggtgagattcgggcgtctccccaccttccagcccctcggtccccggagtcggagggtggccatggataggcttgactgatggcgcgagggaggc

SEQ ID NO: 3625 - DNA, 495 bp, Artificial Sequence
  source: /note="Description of Artificial Sequence: Synthetic polynucleotide"
gccttgccagcccgctcagactgctacgacactctctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgacactctgtcgacactgaagctttctttggacaaggcaccagactcacagttgtaggtaagacatttttcaggttcttttgcagatccgtcacagggaaaagtgggtccacagactgctacgacactctctgatggcgcgagggaggc

SEQ ID NO: 3626 - DNA, 495 bp, Artificial Sequence
  source: /note="Description of Artificial Sequence: Synthetic polynucleotide"
gccttgccagcccgctcagactgctacttcggaacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacttcggaacgtcgactatggctacaccttcggttcggggaccaggttaaccgttgtaggtaaggctgggggtctctaggaggggtgcgatgagggaggactctgtcctgggaaatactgctacttcggaacctgatggcgcgagggaggc

SEQ ID NO: 3627 - DNA, 495 bp, Artificial Sequence
  source: /note="Description of Artificial Sequence: Synthetic polynucleotide"
gccttgccagcccgctcagactgctacaagtaacgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaagtaacggtcgacgaaacaccatatattttggagagggaagttggctcactgttgtaggtgagtaagtcaaggctggacagctgggaacttgcaaaaaggggctggaatccagactgctacaagtaacgctgatggcgcgagggaggc

SEQ ID NO: 3628 - DNA, 495 bp, Artificial Sequence
  source: /note="Description of Artificial Sequence: Synthetic polynucleotide"
gccttgccagcccgctcagactgctacgtctcctactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtctcctagtcgacaatgaaaaactgttttttggcagtggaacccagctctctgtcttgggtatgtaaaagacttctttcgggatagtgtatcataaggtcggagttccaggagactgctacgtctcctactgatggcgcgagggaggc

SEQ ID NO: 3629 - DNA, 495 bp, Artificial Sequence
  source: /note="Description of Artificial Sequence: Synthetic polynucleotide"
gccttgccagcccgctcagactgctacagagtgtcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacagagtgtcgtcgacatcagccccagcattttggtgatgggactcgactctccatcctaggtaagttgcagaatcagggtggtatggccattgtcccttgaaggcagagttctctactgctacagagtgtcctgatggcgcgagggaggc

SEQ ID NO: 3630 - DNA, 495 bp, Artificial Sequence
  source: /note="Description of Artificial Sequence: Synthetic polynucleotide"
gccttgccagcccgctcagactgctacgttccgaactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgttccgaagtcgacataattcacccctccactttgggaacgggaccaggctcactgtgacaggtatgggggctccactcttgactcgggggtgcctgggtttgactgcaatgatactgctacgttccgaactgatggcgcgagggaggc

SEQ ID NO: 3631 - DNA, 495 bp, Artificial Sequence
  source: /note="Description of Artificial Sequence: Synthetic polynucleotide"
gccttgccagcccgctcagactgctaccgttacttctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctaccgttacttgtcgacacaatgagcagttcttcgggccagggacacggctcaccgtgctaggtaagaagggggctccaggtgggagagagggtgagcagcccagcctgcacgacccactgctaccgttacttctgatggcgcgagggaggc

SEQ ID NO: 3632 - DNA, 495 bp, Artificial Sequence
  source: /note="Description of Artificial Sequence: Synthetic polynucleotide"
gccttgccagcccgctcagactgctactaggagacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactaggagacgtcgacaccggggagctgttttttggagaaggctctaggctgaccgtactgggtaaggaggcggttggggctccggagagctccgagagggcgggatgggcagaggactgctactaggagacctgatggcgcgagggaggc

SEQ ID NO: 3633 - DNA, 495 bp, Artificial Sequence
  source: /note="Description of Artificial Sequence: Synthetic polynucleotide"
gccttgccagcccgctcagactgctacgtgtctacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtgtctacgtcgacagatacgcagtattttggcccaggcacccggctgacagtgctcggtaagcgggggctcccgctgaagccccggaactggggagggggcgccccgggacgcactgctacgtgtctacctgatggcgcgagggaggc

SEQ ID NO: 3634 - DNA, 495 bp, Artificial Sequence
  source: /note="Description of Artificial Sequence: Synthetic polynucleotide"
gccttgccagcccgctcagactgctacgtacagtgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtacagtggtcgacaaaacattcagtacttcggcgccgggacccggctctcagtgctgggtaagctggggccgccgggggaccggggacgagactgcgctcgggtttttgtgcgactgctacgtacagtgctgatggcgcgagggaggc

SEQ ID NO: 3635 - DNA, 495 bp, Artificial Sequence
  source: /note="Description of Artificial Sequence: Synthetic polynucleotide"
gccttgccagcccgctcagactgctacggatcatcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacggatcatcgtcgacgagacccagtacttcgggccaggcacgcggctcctggtgctcggtgagcgcgggctgctggggcgcgggcgcgggcggcttgggtctggtttttgcggggactgctacggatcatcctgatggcgcgagggaggc

SEQ ID NO: 3636 - DNA, 495 bp, Artificial Sequence
  source: /note="Description of Artificial Sequence: Synthetic polynucleotide"
gccttgccagcccgctcagactgctactattggcgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactattggcggtcgacgggccaacgtcctgactttcggggccggcagcaggctgaccgtgctgggtgagttttcgcgggaccacccgggcggcgggattcaggtggaaggcggcggactgctactattggcgctgatggcgcgagggaggc

SEQ ID NO: 3637 - DNA, 495 bp, Artificial Sequence
  source: /note="Description of Artificial Sequence: Synthetic polynucleotide"
gccttgccagcccgctcagactgctacaggcttgactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaggcttgagtcgacacgagcagtacttcgggccgggcaccaggctcacggtcacaggtgagattcgggcgtctccccaccttccagcccctcggtccccggagtcggagggtggactgctacaggcttgactgatggcgcgagggaggc

SEQ ID NO: 3638 - DNA, 495 bp, Artificial Sequence
  source: /note="Description of Artificial Sequence: Synthetic polynucleotide"
gccttgccagcccgctcagacgaagatgacactctttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgacactctgtcgacactgaagctttctttggacaaggcaccagactcacagttgtaggtaagacatttttcaggttcttttgcagatccgtcacagggaaaagtgggtccacagacgaagatgacactctctgatggcgcgagggaggc

SEQ ID NO: 3639 - DNA, 495 bp, Artificial Sequence
  source: /note="Description of Artificial Sequence: Synthetic polynucleotide"
gccttgccagcccgctcagacgaagatttcggaacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatttcggaacgtcgactatggctacaccttcggttcggggaccaggttaaccgttgtaggtaaggctgggggtctctaggaggggtgcgatgagggaggactctgtcctgggaaatacgaagatttcggaacctgatggcgcgagggaggc

SEQ ID NO: 3640 - DNA, 495 bp, Artificial Sequence
  source: /note="Description of Artificial Sequence: Synthetic polynucleotide"
gccttgccagcccgctcagacgaagataagtaacgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataagtaacggtcgacgaaacaccatatattttggagagggaagttggctcactgttgtaggtgagtaagtcaaggctggacagctgggaacttgcaaaaaggggctggaatccagacgaagataagtaacgctgatggcgcgagggaggc

SEQ ID NO: 3641 - DNA, 495 bp, Artificial Sequence
  source: /note="Description of Artificial Sequence: Synthetic polynucleotide"
gccttgccagcccgctcagacgaagatgtctcctattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtctcctagtcgacaatgaaaaactgttttttggcagtggaacccagctctctgtcttgggtatgtaaaagacttctttcgggatagtgtatcataaggtcggagttccaggagacgaagatgtctcctactgatggcgcgagggaggc

SEQ ID NO: 3642 - DNA, 495 bp, Artificial Sequence
  source: /note="Description of Artificial Sequence: Synthetic polynucleotide"
gccttgccagcccgctcagacgaagatagagtgtcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatagagtgtcgtcgacatcagccccagcattttggtgatgggactcgactctccatcctaggtaagttgcagaatcagggtggtatggccattgtcccttgaaggcagagttctctacgaagatagagtgtcctgatggcgcgagggaggc

SEQ ID NO: 3643 - DNA, 495 bp, Artificial Sequence
  source: /note="Description of Artificial Sequence: Synthetic polynucleotide"
gccttgccagcccgctcagacgaagatgttccgaattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgttccgaagtcgacataattcacccctccactttgggaacgggaccaggctcactgtgacaggtatgggggctccactcttgactcgggggtgcctgggtttgactgcaatgatacgaagatgttccgaactgatggcgcgagggaggc

SEQ ID NO: 3644 - DNA, 495 bp, Artificial Sequence
  source: /note="Description of Artificial Sequence: Synthetic polynucleotide"
gccttgccagcccgctcagacgaagatcgttacttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatcgttacttgtcgacacaatgagcagttcttcgggccagggacacggctcaccgtgctaggtaagaagggggctccaggtgggagagagggtgagcagcccagcctgcacgacccacgaagatcgttacttctgatggcgcgagggaggc

SEQ ID NO: 3645 - DNA, 495 bp, Artificial Sequence
  source: /note="Description of Artificial Sequence: Synthetic polynucleotide"
gccttgccagcccgctcagacgaagattaggagacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattaggagacgtcgacaccggggagctgttttttggagaaggctctaggctgaccgtactgggtaaggaggcggttggggctccggagagctccgagagggcgggatgggcagaggacgaagattaggagacctgatggcgcgagggaggc

SEQ ID NO: 3646 - DNA, 495 bp, Artificial Sequence
  source: /note="Description of Artificial Sequence: Synthetic polynucleotide"
gccttgccagcccgctcagacgaagatgtgtctacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtgtctacgtcgacagatacgcagtattttggcccaggcacccggctgacagtgctcggtaagcgggggctcccgctgaagccccggaactggggagggggcgccccgggacgcacgaagatgtgtctacctgatggcgcgagggaggc

SEQ ID NO: 3647 - DNA, 495 bp, Artificial Sequence
  source: /note="Description of Artificial Sequence: Synthetic polynucleotide"
gccttgccagcccgctcagacgaagatgtacagtgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtacagtggtcgacaaaacattcagtacttcggcgccgggacccggctctcagtgctgggtaagctggggccgccgggggaccggggacgagactgcgctcgggtttttgtgcgacgaagatgtacagtgctgatggcgcgagggaggc

SEQ ID NO: 3648 - DNA, 495 bp, Artificial Sequence
  source: /note="Description of Artificial Sequence: Synthetic polynucleotide"
gccttgccagcccgctcagacgaagatggatcatcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatggatcatcgtcgacgagacccagtacttcgggccaggcacgcggctcctggtgctcggtgagcgcgggctgctggggcgcgggcgcgggcggcttgggtctggtttttgcggggacgaagatggatcatcctgatggcgcgagggaggc

SEQ ID NO: 3649 - DNA, 495 bp, Artificial Sequence
  source: /note="Description of Artificial Sequence: Synthetic polynucleotide"
gccttgccagcccgctcagacgaagattattggcgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattattggcggtcgacgggccaacgtcctgactttcggggccggcagcaggctgaccgtgctgggtgagttttcgcgggaccacccgggcggcgggattcaggtggaaggcggcggacgaagattattggcgctgatggcgcgagggaggc

SEQ ID NO: 3650 - DNA, 495 bp, Artificial Sequence
  source: /note="Description of Artificial Sequence: Synthetic polynucleotide"
gccttgccagcccgctcagacgaagataggcttgattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataggcttgagtcgacacgagcagtacttcgggccgggcaccaggctcacggtcacaggtgagattcgggcgtctccccaccttccagcccctcggtccccggagtcggagggtggacgaagataggcttgactgatggcgcgagggaggc

SEQ ID NO: 3651 - DNA, 495 bp, Artificial Sequence
  source: /note="Description of Artificial Sequence: Synthetic polynucleotide"
gccttgccagcccgctcagactgtggagacactctcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagacactctgtcgacactgaagctttctttggacaaggcaccagactcacagttgtaggtaagacatttttcaggttcttttgcagatccgtcacagggaaaagtgggtccacagactgtggagacactctctgatggcgcgagggaggc

SEQ ID NO: 3652 - DNA, 495 bp, Artificial Sequence
  source: /note="Description of Artificial Sequence: Synthetic polynucleotide"
gccttgccagcccgctcagactgtggattcggaaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggattcggaacgtcgactatggctacaccttcggttcggggaccaggttaaccgttgtaggtaaggctgggggtctctaggaggggtgcgatgagggaggactctgtcctgggaaatactgtggattcggaacctgatggcgcgagggaggc

SEQ ID NO: 3653 - DNA, 495 bp, Artificial Sequence
  source: /note="Description of Artificial Sequence: Synthetic polynucleotide"
gccttgccagcccgctcagactgtggaaagtaacgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaagtaacggtcgacgaaacaccatatattttggagagggaagttggctcactgttgtaggtgagtaagtcaaggctggacagctgggaacttgcaaaaaggggctggaatccagactgtggaaagtaacgctgatggcgcgagggaggc

SEQ ID NO: 3654 - DNA, 495 bp, Artificial Sequence
  source: /note="Description of Artificial Sequence: Synthetic polynucleotide"
gccttgccagcccgctcagactgtggagtctcctacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtctcctagtcgacaatgaaaaactgttttttggcagtggaacccagctctctgtcttgggtatgtaaaagacttctttcgggatagtgtatcataaggtcggagttccaggagactgtggagtctcctactgatggcgcgagggaggc

SEQ ID NO: 3655 - DNA, 495 bp, Artificial Sequence
  source: /note="Description of Artificial Sequence: Synthetic polynucleotide"
gccttgccagcccgctcagactgtggaagagtgtccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaagagtgtcgtcgacatcagccccagcattttggtgatgggactcgactctccatcctaggtaagttgcagaatcagggtggtatggccattgtcccttgaaggcagagttctctactgtggaagagtgtcctgatggcgcgagggaggc

SEQ ID NO: 3656 - DNA, 495 bp, Artificial Sequence
  source: /note="Description of Artificial Sequence: Synthetic polynucleotide"
gccttgccagcccgctcagactgtggagttccgaacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagttccgaagtcgacataattcacccctccactttgggaacgggaccaggctcactgtgacaggtatgggggctccactcttgactcgggggtgcctgggtttgactgcaatgatactgtggagttccgaactgatggcgcgagggaggc

SEQ ID NO: 3657 - DNA, 495 bp, Artificial Sequence
  source: /note="Description of Artificial Sequence: Synthetic polynucleotide"
gccttgccagcccgctcagactgtggacgttacttcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggacgttacttgtcgacacaatgagcagttcttcgggccagggacacggctcaccgtgctaggtaagaagggggctccaggtgggagagagggtgagcagcccagcctgcacgacccactgtggacgttacttctgatggcgcgagggaggc

SEQ ID NO: 3658 - DNA, 495 bp, Artificial Sequence
  source: /note="Description of Artificial Sequence: Synthetic polynucleotide"
gccttgccagcccgctcagactgtggataggagaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggataggagacgtcgacaccggggagctgttttttggagaaggctctaggctgaccgtactgggtaaggaggcggttggggctccggagagctccgagagggcgggatgggcagaggactgtggataggagacctgatggcgcgagggaggc

SEQ ID NO: 3659 - DNA, 495 bp, Artificial Sequence
  source: /note="Description of Artificial Sequence: Synthetic polynucleotide"
gccttgccagcccgctcagactgtggagtgtctaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtgtctacgtcgacagatacgcagtattttggcccaggcacccggctgacagtgctcggtaagcgggggctcccgctgaagccccggaactggggagggggcgccccgggacgcactgtggagtgtctacctgatggcgcgagggaggc

SEQ ID NO: 3660 - DNA, 495 bp, Artificial Sequence
  source: /note="Description of Artificial Sequence: Synthetic polynucleotide"
gccttgccagcccgctcagactgtggagtacagtgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtacagtggtcgacaaaacattcagtacttcggcgccgggacccggctctcagtgctgggtaagctggggccgccgggggaccggggacgagactgcgctcgggtttttgtgcgactgtggagtacagtgctgatggcgcgagggaggc

SEQ ID NO: 3661 - DNA, 495 bp, Artificial Sequence
  source: /note="Description of Artificial Sequence: Synthetic polynucleotide"
gccttgccagcccgctcagactgtggaggatcatccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaggatcatcgtcgacgagacccagtacttcgggccaggcacgcggctcctggtgctcggtgagcgcgggctgctggggcgcgggcgcgggcggcttgggtctggtttttgcggggactgtggaggatcatcctgatggcgcgagggaggc

SEQ ID NO: 3662 - DNA, 495 bp, Artificial Sequence
  source: /note="Description of Artificial Sequence: Synthetic polynucleotide"
gccttgccagcccgctcagactgtggatattggcgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggatattggcggtcgacgggccaacgtcctgactttcggggccggcagcaggctgaccgtgctgggtgagttttcgcgggaccacccgggcggcgggattcaggtggaaggcggcggactgtggatattggcgctgatggcgcgagggaggc

SEQ ID NO: 3663 - DNA, 495 bp, Artificial Sequence
  source: /note="Description of Artificial Sequence: Synthetic polynucleotide"
gccttgccagcccgctcagactgtggaaggcttgacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaggcttgagtcgacacgagcagtacttcgggccgggcaccaggctcacggtcacaggtgagattcgggcgtctccccaccttccagcccctcggtccccggagtcggagggtggactgtggaaggcttgactgatggcgcgagggaggc

SEQ ID NO: 3664 - DNA, 495 bp, Artificial Sequence
  source: /note="Description of Artificial Sequence: Synthetic polynucleotide"
gccttgccagcccgctcagggtgtcatgacactctcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgacactctgtcgacactgaagctttctttggacaaggcaccagactcacagttgtaggtaagacatttttcaggttcttttgcagatccgtcacagggaaaagtgggtccacagggtgtcatgacactctctgatggcgcgagggaggc

SEQ ID NO: 3665 - DNA, 495 bp, Artificial Sequence
  source: /note="Description of Artificial Sequence: Synthetic polynucleotide"
gccttgccagcccgctcagggtgtcatttcggaaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatttcggaacgtcgactatggctacaccttcggttcggggaccaggttaaccgttgtaggtaaggctgggggtctctaggaggggtgcgatgagggaggactctgtcctgggaaatggtgtcatttcggaacctgatggcgcgagggaggc

SEQ ID NO: 3666 - DNA, 495 bp, Artificial Sequence
  source: /note="Description of Artificial Sequence: Synthetic polynucleotide"
gccttgccagcccgctcagggtgtcataagtaacgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataagtaacggtcgacgaaacaccatatattttggagagggaagttggctcactgttgtaggtgagtaagtcaaggctggacagctgggaacttgcaaaaaggggctggaatccagggtgtcataagtaacgctgatggcgcgagggaggc

SEQ ID NO: 3667 - DNA, 495 bp, Artificial Sequence
  source: /note="Description of Artificial Sequence: Synthetic polynucleotide"
gccttgccagcccgctcagggtgtcatgtctcctacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtctcctagtcgacaatgaaaaactgttttttggcagtggaacccagctctctgtcttgggtatgtaaaagacttctttcgggatagtgtatcataaggtcggagttccaggagggtgtcatgtctcctactgatggcgcgagggaggc

SEQ ID NO: 3668 - DNA, 495 bp, Artificial Sequence
  source: /note="Description of Artificial Sequence: Synthetic polynucleotide"
gccttgccagcccgctcagggtgtcatagagtgtccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatagagtgtcgtcgacatcagccccagcattttggtgatgggactcgactctccatcctaggtaagttgcagaatcagggtggtatggccattgtcccttgaaggcagagttctctggtgtcatagagtgtcctgatggcgcgagggaggc

SEQ ID NO: 3669 - DNA, 495 bp, Artificial Sequence
  source: /note="Description of Artificial Sequence: Synthetic polynucleotide"
gccttgccagcccgctcagggtgtcatgttccgaacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgttccgaagtcgacataattcacccctccactttgggaacgggaccaggctcactgtgacaggtatgggggctccactcttgactcgggggtgcctgggtttgactgcaatgatggtgtcatgttccgaactgatggcgcgagggaggc

SEQ ID NO: 3670 - DNA, 495 bp, Artificial Sequence
  source: /note="Description of Artificial Sequence: Synthetic polynucleotide"
gccttgccagcccgctcagggtgtcatcgttacttcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatcgttacttgtcgacacaatgagcagttcttcgggccagggacacggctcaccgtgctaggtaagaagggggctccaggtgggagagagggtgagcagcccagcctgcacgacccggtgtcatcgttacttctgatggcgcgagggaggc

SEQ ID NO: 3671 - DNA, 495 bp, Artificial Sequence
  source: /note="Description of Artificial Sequence: Synthetic polynucleotide"
gccttgccagcccgctcagggtgtcattaggagaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattaggagacgtcgacaccggggagctgttttttggagaaggctctaggctgaccgtactgggtaaggaggcggttggggctccggagagctccgagagggcgggatgggcagaggggtgtcattaggagacctgatggcgcgagggaggc

SEQ ID NO: 3672 - DNA, 495 bp, Artificial Sequence
  source: /note="Description of Artificial Sequence: Synthetic polynucleotide"
gccttgccagcccgctcagggtgtcatgtgtctaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtgtctacgtcgacagatacgcagtattttggcccaggcacccggctgacagtgctcggtaagcgggggctcccgctgaagccccggaactggggagggggcgccccgggacgcggtgtcatgtgtctacctgatggcgcgagggaggc

SEQ ID NO: 3673 - DNA, 495 bp, Artificial Sequence
  source: /note="Description of Artificial Sequence: Synthetic polynucleotide"
gccttgccagcccgctcagggtgtcatgtacagtgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtacagtggtcgacaaaacattcagtacttcggcgccgggacccggctctcagtgctgggtaagctggggccgccgggggaccggggacgagactgcgctcgggtttttgtgcgggtgtcatgtacagtgctgatggcgcgagggaggc

SEQ ID NO: 3674 - DNA, 495 bp, Artificial Sequence
  source: /note="Description of Artificial Sequence: Synthetic polynucleotide"
gccttgccagcccgctcagggtgtcatggatcatccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatggatcatcgtcgacgagacccagtacttcgggccaggcacgcggctcctggtgctcggtgagcgcgggctgctggggcgcgggcgcgggcggcttgggtctggtttttgcggggggtgtcatggatcatcctgatggcgcgagggaggc

SEQ ID NO: 3675 - DNA, 495 bp, Artificial Sequence
  source: /note="Description of Artificial Sequence: Synthetic polynucleotide"
gccttgccagcccgctcagggtgtcattattggcgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattattggcggtcgacgggccaacgtcctgactttcggggccggcagcaggctgaccgtgctgggtgagttttcgcgggaccacccgggcggcgggattcaggtggaaggcggcggggtgtcattattggcgctgatggcgcgagggaggc

SEQ ID NO: 3676 - DNA, 495 bp, Artificial Sequence
  source: /note="Description of Artificial Sequence: Synthetic polynucleotide"
gccttgccagcccgctcagggtgtcataggcttgacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataggcttgagtcgacacgagcagtacttcgggccgggcaccaggctcacggtcacaggtgagattcgggcgtctccccaccttccagcccctcggtccccggagtcggagggtggggtgtcataggcttgactgatggcgcgagggaggc

SEQ ID NO: 3677 - DNA, 495 bp, Artificial Sequence
  source: /note="Description of Artificial Sequence: Synthetic polynucleotide"
gccttgccagcccgctcagtcgtgaaggacactctccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggacactctgtcgacactgaagctttctttggacaaggcaccagactcacagttgtaggtaagacatttttcaggttcttttgcagatccgtcacagggaaaagtgggtccacagtcgtgaaggacactctctgatggcgcgagggaggc

SEQ ID NO: 3678 - DNA, 495 bp, Artificial Sequence
  source: /note="Description of Artificial Sequence: Synthetic polynucleotide"
gccttgccagcccgctcagtcgtgaagttcggaacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagttcggaacgtcgactatggctacaccttcggttcggggaccaggttaaccgttgtaggtaaggctgggggtctctaggaggggtgcgatgagggaggactctgtcctgggaaattcgtgaagttcggaacctgatggcgcgagggaggc

SEQ ID NO: 3679 - DNA, 495 bp, Artificial Sequence
  source: /note="Description of Artificial Sequence: Synthetic polynucleotide"
gccttgccagcccgctcagtcgtgaagaagtaacgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaagtaacggtcgacgaaacaccatatattttggagagggaagttggctcactgttgtaggtgagtaagtcaaggctggacagctgggaacttgcaaaaaggggctggaatccagtcgtgaagaagtaacgctgatggcgcgagggaggc

SEQ ID NO: 3680 - DNA, 495 bp, Artificial Sequence
  source: /note="Description of Artificial Sequence: Synthetic polynucleotide"
gccttgccagcccgctcagtcgtgaaggtctcctaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtctcctagtcgacaatgaaaaactgttttttggcagtggaacccagctctctgtcttgggtatgtaaaagacttctttcgggatagtgtatcataaggtcggagttccaggagtcgtgaaggtctcctactgatggcgcgagggaggc

SEQ ID NO: 3681 - DNA, 495 bp, Artificial Sequence
  source: /note="Description of Artificial Sequence: Synthetic polynucleotide"
gccttgccagcccgctcagtcgtgaagagagtgtcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagagagtgtcgtcgacatcagccccagcattttggtgatgggactcgactctccatcctaggtaagttgcagaatcagggtggtatggccattgtcccttgaaggcagagttctcttcgtgaagagagtgtcctgatggcgcgagggaggc

SEQ ID NO: 3682 - DNA, 495 bp, Artificial Sequence
  source: /note="Description of Artificial Sequence: Synthetic polynucleotide"
gccttgccagcccgctcagtcgtgaaggttccgaaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggttccgaagtcgacataattcacccctccactttgggaacgggaccaggctcactgtgacaggtatgggggctccactcttgactcgggggtgcctgggtttgactgcaatgattcgtgaaggttccgaactgatggcgcgagggaggc

SEQ ID NO: 3683 - DNA, 495 bp, Artificial Sequence
  source: /note="Description of Artificial Sequence: Synthetic polynucleotide"
gccttgccagcccgctcagtcgtgaagcgttacttccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagcgttacttgtcgacacaatgagcagttcttcgggccagggacacggctcaccgtgctaggtaagaagggggctccaggtgggagagagggtgagcagcccagcctgcacgaccctcgtgaagcgttacttctgatggcgcgagggaggc

SEQ ID NO: 3684 - DNA, 495 bp, Artificial Sequence
  source: /note="Description of Artificial Sequence: Synthetic polynucleotide"
gccttgccagcccgctcagtcgtgaagtaggagacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtaggagacgtcgacaccggggagctgttttttggagaaggctctaggctgaccgtactgggtaaggaggcggttggggctccggagagctccgagagggcgggatgggcagaggtcgtgaagtaggagacctgatggcgcgagggaggc

SEQ ID NO: 3685 - DNA, 495 bp, Artificial Sequence
  source: /note="Description of Artificial Sequence: Synthetic polynucleotide"
gccttgccagcccgctcagtcgtgaaggtgtctacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtgtctacgtcgacagatacgcagtattttggcccaggcacccggctgacagtgctcggtaagcgggggctcccgctgaagccccggaactggggagggggcgccccgggacgctcgtgaaggtgtctacctgatggcgcgagggaggc

SEQ ID NO: 3686 - DNA, 495 bp, Artificial Sequence
  source: /note="Description of Artificial Sequence: Synthetic polynucleotide"
gccttgccagcccgctcagtcgtgaaggtacagtgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtacagtggtcgacaaaacattcagtacttcggcgccgggacccggctctcagtgctgggtaagctggggccgccgggggaccggggacgagactgcgctcgggtttttgtgcgtcgtgaaggtacagtgctgatggcgcgagggaggc

SEQ ID NO: 3687 - DNA, 495 bp, Artificial Sequence
  source: /note="Description of Artificial Sequence: Synthetic polynucleotide"
gccttgccagcccgctcagtcgtgaagggatcatcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagggatcatcgtcgacgagacccagtacttcgggccaggcacgcggctcctggtgctcggtgagcgcgggctgctggggcgcgggcgcgggcggcttgggtctggtttttgcggggtcgtgaagggatcatcctgatggcgcgagggaggc

SEQ ID NO: 3688 - DNA, 495 bp, Artificial Sequence
  source: /note="Description of Artificial Sequence: Synthetic polynucleotide"
gccttgccagcccgctcagtcgtgaagtattggcgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtattggcggtcgacgggccaacgtcctgactttcggggccggcagcaggctgaccgtgctgggtgagttttcgcgggaccacccgggcggcgggattcaggtggaaggcggcggtcgtgaagtattggcgctgatggcgcgagggaggc

SEQ ID NO: 3689 - DNA, 495 bp, Artificial Sequence
  source: /note="Description of Artificial Sequence: Synthetic polynucleotide"
gccttgccagcccgctcagtcgtgaagaggcttgaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaggcttgagtcgacacgagcagtacttcgggccgggcaccaggctcacggtcacaggtgagattcgggcgtctccccaccttccagcccctcggtccccggagtcggagggtggtcgtgaagaggcttgactgatggcgcgagggaggc

SEQ ID NO: 3690 - DNA, 495 bp, Artificial Sequence
  source: /note="Description of Artificial Sequence: Synthetic polynucleotide"
gccttgccagcccgctcagcactagctgacactctttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgacactctgtcgacactgaagctttctttggacaaggcaccagactcacagttgtaggtaagacatttttcaggttcttttgcagatccgtcacagggaaaagtgggtccacagcactagctgacactctctgatggcgcgagggaggc

SEQ ID NO: 3691 - DNA, 495 bp, Artificial Sequence
  source: /note="Description of Artificial Sequence: Synthetic polynucleotide"
gccttgccagcccgctcagcactagctttcggaacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctttcggaacgtcgactatggctacaccttcggttcggggaccaggttaaccgttgtaggtaaggctgggggtctctaggaggggtgcgatgagggaggactctgtcctgggaaatcactagctttcggaacctgatggcgcgagggaggc

SEQ ID NO: 3692 - DNA, 495 bp, Artificial Sequence
  source: /note="Description of Artificial Sequence: Synthetic polynucleotide"
gccttgccagcccgctcagcactagctaagtaacgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaagtaacggtcgacgaaacaccatatattttggagagggaagttggctcactgttgtaggtgagtaagtcaaggctggacagctgggaacttgcaaaaaggggctggaatccagcactagctaagtaacgctgatggcgcgagggaggc

SEQ ID NO: 3693 - DNA, 495 bp, Artificial Sequence
  source: /note="Description of Artificial Sequence: Synthetic polynucleotide"
gccttgccagcccgctcagcactagctgtctcctattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtctcctagtcgacaatgaaaaactgttttttggcagtggaacccagctctctgtcttgggtatgtaaaagacttctttcgggatagtgtatcataaggtcggagttccaggagcactagctgtctcctactgatggcgcgagggaggc

SEQ ID NO: 3694 - DNA, 495 bp, Artificial Sequence
  source: /note="Description of Artificial Sequence: Synthetic polynucleotide"
gccttgccagcccgctcagcactagctagagtgtcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctagagtgtcgtcgacatcagccccagcattttggtgatgggactcgactctccatcctaggtaagttgcagaatcagggtggtatggccattgtcccttgaaggcagagttctctcactagctagagtgtcctgatggcgcgagggaggc

SEQ ID NO: 3695 - DNA, 495 bp, Artificial Sequence
  source: /note="Description of Artificial Sequence: Synthetic polynucleotide"
gccttgccagcccgctcagcactagctgttccgaattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgttccgaagtcgacataattcacccctccactttgggaacgggaccaggctcactgtgacaggtatgggggctccactcttgactcgggggtgcctgggtttgactgcaatgatcactagctgttccgaactgatggcgcgagggaggc

SEQ ID NO: 3696 - DNA, 495 bp, Artificial Sequence
  source: /note="Description of Artificial Sequence: Synthetic polynucleotide"
gccttgccagcccgctcagcactagctcgttacttttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctcgttacttgtcgacacaatgagcagttcttcgggccagggacacggctcaccgtgctaggtaagaagggggctccaggtgggagagagggtgagcagcccagcctgcacgaccccactagctcgttacttctgatggcgcgagggaggc

SEQ ID NO: 3697 - DNA, 495 bp, Artificial Sequence
  source: /note="Description of Artificial Sequence: Synthetic polynucleotide"
gccttgccagcccgctcagcactagcttaggagacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttaggagacgtcgacaccggggagctgttttttggagaaggctctaggctgaccgtactgggtaaggaggcggttggggctccggagagctccgagagggcgggatgggcagaggcactagcttaggagacctgatggcgcgagggaggc

SEQ ID NO: 3698 - DNA, 495 bp, Artificial Sequence
  source: /note="Description of Artificial Sequence: Synthetic polynucleotide"
gccttgccagcccgctcagcactagctgtgtctacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtgtctacgtcgacagatacgcagtattttggcccaggcacccggctgacagtgctcggtaagcgggggctcccgctgaagccccggaactggggagggggcgccccgggacgccactagctgtgtctacctgatggcgcgagggaggc

SEQ ID NO: 3699 - DNA, 495 bp, Artificial Sequence
  source: /note="Description of Artificial Sequence: Synthetic polynucleotide"
gccttgccagcccgctcagcactagctgtacagtgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtacagtggtcgacaaaacattcagtacttcggcgccgggacccggctctcagtgctgggtaagctggggccgccgggggaccggggacgagactgcgctcgggtttttgtgcgcactagctgtacagtgctgatggcgcgagggaggc

SEQ ID NO: 3700 - DNA, 495 bp, Artificial Sequence
  source: /note="Description of Artificial Sequence: Synthetic polynucleotide"
gccttgccagcccgctcagcactagctggatcatcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctggatcatcgtcgacgagacccagtacttcgggccaggcacgcggctcctggtgctcggtgagcgcgggctgctggggcgcgggcgcgggcggcttgggtctggtttttgcggggcactagctggatcatcctgatggcgcgagggaggc

SEQ ID NO: 3701 - DNA, 495 bp, Artificial Sequence
  source: /note="Description of Artificial Sequence: Synthetic polynucleotide"
gccttgccagcccgctcagcactagcttattggcgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttattggcggtcgacgggccaacgtcctgactttcggggccggcagcaggctgaccgtgctgggtgagttttcgcgggaccacccgggcggcgggattcaggtggaaggcggcggcactagcttattggcgctgatggcgcgagggaggc

SEQ ID NO: 3702 - DNA, 495 bp, Artificial Sequence
  source: /note="Description of Artificial Sequence: Synthetic polynucleotide"
gccttgccagcccgctcagcactagctaggcttgattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaggcttgagtcgacacgagcagtacttcgggccgggcaccaggctcacggtcacaggtgagattcgggcgtctccccaccttccagcccctcggtccccggagtcggagggtggcactagctaggcttgactgatggcgcgagggaggc

SEQ ID NO: 3703 - DNA, 495 bp, Artificial Sequence
  source: /note="Description of Artificial Sequence: Synthetic polynucleotide"
gccttgccagcccgctcagcttggttagacactctttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagacactctgtcgacactgaagctttctttggacaaggcaccagactcacagttgtaggtaagacatttttcaggttcttttgcagatccgtcacagggaaaagtgggtccacagcttggttagacactctctgatggcgcgagggaggc

SEQ ID NO: 3704 - DNA, 495 bp, Artificial Sequence
  source: /note="Description of Artificial Sequence: Synthetic polynucleotide"
gccttgccagcccgctcagcttggttattcggaacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttattcggaacgtcgactatggctacaccttcggttcggggaccaggttaaccgttgtaggtaaggctgggggtctctaggaggggtgcgatgagggaggactctgtcctgggaaatcttggttattcggaacctgatggcgcgagggaggc

SEQ ID NO: 3705 - DNA, 495 bp, Artificial Sequence
  source: /note="Description of Artificial Sequence: Synthetic polynucleotide"
gccttgccagcccgctcagcttggttaaagtaacgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaagtaacggtcgacgaaacaccatatattttggagagggaagttggctcactgttgtaggtgagtaagtcaaggctggacagctgggaacttgcaaaaaggggctggaatccagcttggttaaagtaacgctgatggcgcgagggaggc

SEQ ID NO: 3706 - DNA, 495 bp, Artificial Sequence
  source: /note="Description of Artificial Sequence: Synthetic polynucleotide"
gccttgccagcccgctcagcttggttagtctcctattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtctcctagtcgacaatgaaaaactgttttttggcagtggaacccagctctctgtcttgggtatgtaaaagacttctttcgggatagtgtatcataaggtcggagttccaggagcttggttagtctcctactgatggcgcgagggaggc

SEQ ID NO: 3707 - DNA, 495 bp, Artificial Sequence
  source: /note="Description of Artificial Sequence: Synthetic polynucleotide"
gccttgccagcccgctcagcttggttaagagtgtcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaagagtgtcgtcgacatcagccccagcattttggtgatgggactcgactctccatcctaggtaagttgcagaatcagggtggtatggccattgtcccttgaaggcagagttctctcttggttaagagtgtcctgatggcgcgagggaggc

SEQ ID NO: 3708 - DNA, 495 bp, Artificial Sequence
  source: /note="Description of Artificial Sequence: Synthetic polynucleotide"
gccttgccagcccgctcagcttggttagttccgaattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagttccgaagtcgacataattcacccctccactttgggaacgggaccaggctcactgtgacaggtatgggggctccactcttgactcgggggtgcctgggtttgactgcaatgatcttggttagttccgaactgatggcgcgagggaggc

SEQ ID NO: 3709 - DNA, 495 bp, Artificial Sequence
  source: /note="Description of Artificial Sequence: Synthetic polynucleotide"
gccttgccagcccgctcagcttggttacgttacttttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttacgttacttgtcgacacaatgagcagttcttcgggccagggacacggctcaccgtgctaggtaagaagggggctccaggtgggagagagggtgagcagcccagcctgcacgaccccttggttacgttacttctgatggcgcgagggaggc

SEQ ID NO: 3710 - DNA, 495 bp, Artificial Sequence
  source: /note="Description of Artificial Sequence: Synthetic polynucleotide"
gccttgccagcccgctcagcttggttataggagacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttataggagacgtcgacaccggggagctgttttttggagaaggctctaggctgaccgtactgggtaaggaggcggttggggctccggagagctccgagagggcgggatgggcagaggcttggttataggagacctgatggcgcgagggaggc

SEQ ID NO: 3711 - DNA, 495 bp, Artificial Sequence
  source: /note="Description of Artificial Sequence: Synthetic polynucleotide"
gccttgccagcccgctcagcttggttagtgtctacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtgtctacgtcgacagatacgcagtattttggcccaggcacccggctgacagtgctcggtaagcgggggctcccgctgaagccccggaactggggagggggcgccccgggacgccttggttagtgtctacctgatggcgcgagggaggc

SEQ ID NO: 3712 - DNA, 495 bp, Artificial Sequence
  source: /note="Description of Artificial Sequence: Synthetic polynucleotide"
gccttgccagcccgctcagcttggttagtacagtgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtacagtggtcgacaaaacattcagtacttcggcgccgggacccggctctcagtgctgggtaagctggggccgccgggggaccggggacgagactgcgctcgggtttttgtgcgcttggttagtacagtgctgatggcgcgagggaggc

SEQ ID NO: 3713 - DNA, 495 bp, Artificial Sequence
  source: /note="Description of Artificial Sequence: Synthetic polynucleotide"
gccttgccagcccgctcagcttggttaggatcatcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaggatcatcgtcgacgagacccagtacttcgggccaggcacgcggctcctggtgctcggtgagcgcgggctgctggggcgcgggcgcgggcggcttgggtctggtttttgcggggcttggttaggatcatcctgatggcgcgagggaggc

SEQ ID NO: 3714 - DNA, 495 bp, Artificial Sequence
  source: /note="Description of Artificial Sequence: Synthetic polynucleotide"
gccttgccagcccgctcagcttggttatattggcgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttatattggcggtcgacgggccaacgtcctgactttcggggccggcagcaggctgaccgtgctgggtgagttttcgcgggaccacccgggcggcgggattcaggtggaaggcggcggcttggttatattggcgctgatggcgcgagggaggc

SEQ ID NO: 3715 - DNA, 495 bp, Artificial Sequence
  source: /note="Description of Artificial Sequence: Synthetic polynucleotide"
gccttgccagcccgctcagcttggttaaggcttgattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaggcttgagtcgacacgagcagtacttcgggccgggcaccaggctcacggtcacaggtgagattcgggcgtctccccaccttccagcccctcggtccccggagtcggagggtggcttggttaaggcttgactgatggcgcgagggaggc

SEQ ID NO: 3716 - DNA, 495 bp, Artificial Sequence
  source: /note="Description of Artificial Sequence: Synthetic polynucleotide"
gccttgccagcccgctcagacctcttggacactcttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggacactctgtcgacactgaagctttctttggacaaggcaccagactcacagttgtaggtaagacatttttcaggttcttttgcagatccgtcacagggaaaagtgggtccacagacctcttggacactctctgatggcgcgagggaggc

SEQ ID NO: 3717 - DNA, 495 bp, Artificial Sequence
  source: /note="Description of Artificial Sequence: Synthetic polynucleotide"
gccttgccagcccgctcagacctcttgttcggaactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgttcggaacgtcgactatggctacaccttcggttcggggaccaggttaaccgttgtaggtaaggctgggggtctctaggaggggtgcgatgagggaggactctgtcctgggaaatacctcttgttcggaacctgatggcgcgagggaggc

SEQ ID NO: 3718 - DNA, 495 bp, Artificial Sequence
  source: /note="Description of Artificial Sequence: Synthetic polynucleotide"
gccttgccagcccgctcagacctcttgaagtaacgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaagtaacggtcgacgaaacaccatatattttggagagggaagttggctcactgttgtaggtgagtaagtcaaggctggacagctgggaacttgcaaaaaggggctggaatccagacctcttgaagtaacgctgatggcgcgagggaggc

SEQ ID NO: 3719 - DNA, 495 bp, Artificial Sequence
  source: /note="Description of Artificial Sequence: Synthetic polynucleotide"
gccttgccagcccgctcagacctcttggtctcctatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtctcctagtcgacaatgaaaaactgttttttggcagtggaacccagctctctgtcttgggtatgtaaaagacttctttcgggatagtgtatcataaggtcggagttccaggagacctcttggtctcctactgatggcgcgagggaggc

SEQ ID NO: 3720 - DNA, 495 bp, Artificial Sequence
  source: /note="Description of Artificial Sequence: Synthetic polynucleotide"
gccttgccagcccgctcagacctcttgagagtgtctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgagagtgtcgtcgacatcagccccagcattttggtgatgggactcgactctccatcctaggtaagttgcagaatcagggtggtatggccattgtcccttgaaggcagagttctctacctcttgagagtgtcctgatggcgcgagggaggc

SEQ ID NO: 3721 - DNA, 495 bp, Artificial Sequence
  source: /note="Description of Artificial Sequence: Synthetic polynucleotide"
gccttgccagcccgctcagacctcttggttccgaatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggttccgaagtcgacataattcacccctccactttgggaacgggaccaggctcactgtgacaggtatgggggctccactcttgactcgggggtgcctgggtttgactgcaatgatacctcttggttccgaactgatggcgcgagggaggc

SEQ ID NO: 3722 - DNA, 495 bp, Artificial Sequence
  source: /note="Description of Artificial Sequence: Synthetic polynucleotide"
gccttgccagcccgctcagacctcttgcgttactttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgcgttacttgtcgacacaatgagcagttcttcgggccagggacacggctcaccgtgctaggtaagaagggggctccaggtgggagagagggtgagcagcccagcctgcacgacccacctcttgcgttacttctgatggcgcgagggaggc

SEQ ID NO: 3723 - DNA, 495 bp, Artificial Sequence
  source: /note="Description of Artificial Sequence: Synthetic polynucleotide"
gccttgccagcccgctcagacctcttgtaggagactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtaggagacgtcgacaccggggagctgttttttggagaaggctctaggctgaccgtactgggtaaggaggcggttggggctccggagagctccgagagggcgggatgggcagaggacctcttgtaggagacctgatggcgcgagggaggc

SEQ ID NO: 3724 - DNA, 495 bp, Artificial Sequence
  source: /note="Description of Artificial Sequence: Synthetic polynucleotide"
gccttgccagcccgctcagacctcttggtgtctactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtgtctacgtcgacagatacgcagtattttggcccaggcacccggctgacagtgctcggtaagcgggggctcccgctgaagccccggaactggggagggggcgccccgggacgcacctcttggtgtctacctgatggcgcgagggaggc

SEQ ID NO: 3725 - DNA, 495 bp, Artificial Sequence
  source: /note="Description of Artificial Sequence: Synthetic polynucleotide"
gccttgccagcccgctcagacctcttggtacagtgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtacagtggtcgacaaaacattcagtacttcggcgccgggacccggctctcagtgctgggtaagctggggccgccgggggaccggggacgagactgcgctcgggtttttgtgcgacctcttggtacagtgctgatggcgcgagggaggc

SEQ ID NO: 3726 - DNA, 495 bp, Artificial Sequence
  source: /note="Description of Artificial Sequence: Synthetic polynucleotide"
gccttgccagcccgctcagacctcttgggatcatctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgggatcatcgtcgacgagacccagtacttcgggccaggcacgcggctcctggtgctcggtgagcgcgggctgctggggcgcgggcgcgggcggcttgggtctggtttttgcggggacctcttgggatcatcctgatggcgcgagggaggc

SEQ ID NO: 3727 - DNA, 495 bp, Artificial Sequence
  source: /note="Description of Artificial Sequence: Synthetic polynucleotide"
gccttgccagcccgctcagacctcttgtattggcgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtattggcggtcgacgggccaacgtcctgactttcggggccggcagcaggctgaccgtgctgggtgagttttcgcgggaccacccgggcggcgggattcaggtggaaggcggcggacctcttgtattggcgctgatggcgcgagggaggc

SEQ ID NO: 3728 - DNA, 495 bp, Artificial Sequence
  source: /note="Description of Artificial Sequence: Synthetic polynucleotide"
gccttgccagcccgctcagacctcttgaggcttgatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaggcttgagtcgacacgagcagtacttcgggccgggcaccaggctcacggtcacaggtgagattcgggcgtctccccaccttccagcccctcggtccccggagtcggagggtggacctcttgaggcttgactgatggcgcgagggaggc

SEQ ID NO: 3729 - DNA, 495 bp, Artificial Sequence
  source: /note="Description of Artificial Sequence: Synthetic polynucleotide"
gccttgccagcccgctcagctgattctgacactctcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgacactctgtcgacactgaagctttctttggacaaggcaccagactcacagttgtaggtaagacatttttcaggttcttttgcagatccgtcacagggaaaagtgggtccacagctgattctgacactctctgatggcgcgagggaggc

SEQ ID NO: 3730 - DNA, 495 bp, Artificial Sequence
  source: /note="Description of Artificial Sequence: Synthetic polynucleotide"
gccttgccagcccgctcagctgattctttcggaaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctttcggaacgtcgactatggctacaccttcggttcggggaccaggttaaccgttgtaggtaaggctgggggtctctaggaggggtgcgatgagggaggactctgtcctgggaaatctgattctttcggaacctgatggcgcgagggaggc

SEQ ID NO: 3731 - DNA, 495 bp, Artificial Sequence
  source: /note="Description of Artificial Sequence: Synthetic polynucleotide"
gccttgccagcccgctcagctgattctaagtaacgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaagtaacggtcgacgaaacaccatatattttggagagggaagttggctcactgttgtaggtgagtaagtcaaggctggacagctgggaacttgcaaaaaggggctggaatccagctgattctaagtaacgctgatggcgcgagggaggc

SEQ ID NO: 3732 - DNA, 495 bp, Artificial Sequence
  source: /note="Description of Artificial Sequence: Synthetic polynucleotide"
gccttgccagcccgctcagctgattctgtctcctacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtctcctagtcgacaatgaaaaactgttttttggcagtggaacccagctctctgtcttgggtatgtaaaagacttctttcgggatagtgtatcataaggtcggagttccaggagctgattctgtctcctactgatggcgcgagggaggc

SEQ ID NO: 3733 - DNA, 495 bp, Artificial Sequence
  source: /note="Description of Artificial Sequence: Synthetic polynucleotide"
gccttgccagcccgctcagctgattctagagtgtccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctagagtgtcgtcgacatcagccccagcattttggtgatgggactcgactctccatcctaggtaagttgcagaatcagggtggtatggccattgtcccttgaaggcagagttctctctgattctagagtgtcctgatggcgcgagggaggc

SEQ ID NO: 3734 - DNA, 495 bp, Artificial Sequence
  source: /note="Description of Artificial Sequence: Synthetic polynucleotide"
gccttgccagcccgctcagctgattctgttccgaacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgttccgaagtcgacataattcacccctccactttgggaacgggaccaggctcactgtgacaggtatgggggctccactcttgactcgggggtgcctgggtttgactgcaatgatctgattctgttccgaactgatggcgcgagggaggc

SEQ ID NO: 3735 - DNA, 495 bp, Artificial Sequence
  source: /note="Description of Artificial Sequence: Synthetic polynucleotide"
gccttgccagcccgctcagctgattctcgttacttcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctcgttacttgtcgacacaatgagcagttcttcgggccagggacacggctcaccgtgctaggtaagaagggggctccaggtgggagagagggtgagcagcccagcctgcacgacccctgattctcgttacttctgatggcgcgagggaggc

SEQ ID NO: 3736 - DNA, 495 bp, Artificial Sequence
  source: /note="Description of Artificial Sequence: Synthetic polynucleotide"
gccttgccagcccgctcagctgattcttaggagaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttaggagacgtcgacaccggggagctgttttttggagaaggctctaggctgaccgtactgggtaaggaggcggttggggctccggagagctccgagagggcgggatgggcagaggctgattcttaggagacctgatggcgcgagggaggc

SEQ ID NO: 3737 - DNA, 495 bp, Artificial Sequence
  source: /note="Description of Artificial Sequence: Synthetic polynucleotide"
gccttgccagcccgctcagctgattctgtgtctaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtgtctacgtcgacagatacgcagtattttggcccaggcacccggctgacagtgctcggtaagcgggggctcccgctgaagccccggaactggggagggggcgccccgggacgcctgattctgtgtctacctgatggcgcgagggaggc

SEQ ID NO: 3738 - DNA, 495 bp, Artificial Sequence
  source: /note="Description of Artificial Sequence: Synthetic polynucleotide"
gccttgccagcccgctcagctgattctgtacagtgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtacagtggtcgacaaaacattcagtacttcggcgccgggacccggctctcagtgctgggtaagctggggccgccgggggaccggggacgagactgcgctcgggtttttgtgcgctgattctgtacagtgctgatggcgcgagggaggc

SEQ ID NO: 3739 - DNA, 495 bp, Artificial Sequence
  source: /note="Description of Artificial Sequence: Synthetic polynucleotide"
gccttgccagcccgctcagctgattctggatcatccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctggatcatcgtcgacgagacccagtacttcgggccaggcacgcggctcctggtgctcggtgagcgcgggctgctggggcgcgggcgcgggcggcttgggtctggtttttgcggggctgattctggatcatcctgatggcgcgagggaggc

SEQ ID NO: 3740 - DNA, 495 bp, Artificial Sequence
  source: /note="Description of Artificial Sequence: Synthetic polynucleotide"
gccttgccagcccgctcagctgattcttattggcgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttattggcggtcgacgggccaacgtcctgactttcggggccggcagcaggctgaccgtgctgggtgagttttcgcgggaccacccgggcggcgggattcaggtggaaggcggcggctgattcttattggcgctgatggcgcgagggaggc

SEQ ID NO: 3741 - DNA, 495 bp, Artificial Sequence
  source: /note="Description of Artificial Sequence: Synthetic polynucleotide"
gccttgccagcccgctcagctgattctaggcttgacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaggcttgagtcgacacgagcagtacttcgggccgggcaccaggctcacggtcacaggtgagattcgggcgtctccccaccttccagcccctcggtccccggagtcggagggtggctgattctaggcttgactgatggcgcgagggaggc

SEQ ID NO: 3742 - DNA, 495 bp, Artificial Sequence
  source: /note="Description of Artificial Sequence: Synthetic polynucleotide"
gccttgccagcccgctcagggtcaactgacactcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgacactctgtcgacactgaagctttctttggacaaggcaccagactcacagttgtaggtaagacatttttcaggttcttttgcagatccgtcacagggaaaagtgggtccacagggtcaactgacactctctgatggcgcgagggaggc

SEQ ID NO: 3743 - DNA, 495 bp, Artificial Sequence
  source: /note="Description of Artificial Sequence: Synthetic polynucleotide"
gccttgccagcccgctcagggtcaactttcggaactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactttcggaacgtcgactatggctacaccttcggttcggggaccaggttaaccgttgtaggtaaggctgggggtctctaggaggggtgcgatgagggaggactctgtcctgggaaatggtcaactttcggaacctgatggcgcgagggaggc

SEQ ID NO: 3744 - DNA, 495 bp, Artificial Sequence
  source: /note="Description of Artificial Sequence: Synthetic polynucleotide"
gccttgccagcccgctcagggtcaactaagtaacgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaagtaacggtcgacgaaacaccatatattttggagagggaagttggctcactgttgtaggtgagtaagtcaaggctggacagctgggaacttgcaaaaaggggctggaatccagggtcaactaagtaacgctgatggcgcgagggaggc

SEQ ID NO: 3745 - DNA, 495 bp, Artificial Sequence
  source: /note="Description of Artificial Sequence: Synthetic polynucleotide"
gccttgccagcccgctcagggtcaactgtctcctatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtctcctagtcgacaatgaaaaactgttttttggcagtggaacccagctctctgtcttgggtatgtaaaagacttctttcgggatagtgtatcataaggtcggagttccaggagggtcaactgtctcctactgatggcgcgagggaggc

SEQ ID NO: 3746 - DNA, 495 bp, Artificial Sequence
  source: /note="Description of Artificial Sequence: Synthetic polynucleotide"
gccttgccagcccgctcagggtcaactagagtgtctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactagagtgtcgtcgacatcagccccagcattttggtgatgggactcgactctccatcctaggtaagttgcagaatcagggtggtatggccattgtcccttgaaggcagagttctctggtcaactagagtgtcctgatggcgcgagggaggc

SEQ ID NO: 3747 - DNA, 495 bp, Artificial Sequence
  source: /note="Description of Artificial Sequence: Synthetic polynucleotide"
gccttgccagcccgctcagggtcaactgttccgaatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgttccgaagtcgacataattcacccctccactttgggaacgggaccaggctcactgtgacaggtatgggggctccactcttgactcgggggtgcctgggtttgactgcaatgatggtcaactgttccgaactgatggcgcgagggaggc

SEQ ID NO: 3748 - DNA, 495 bp, Artificial Sequence
  source: /note="Description of Artificial Sequence: Synthetic polynucleotide"
gccttgccagcccgctcagggtcaactcgttactttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactcgttacttgtcgacacaatgagcagttcttcgggccagggacacggctcaccgtgctaggtaagaagggggctccaggtgggagagagggtgagcagcccagcctgcacgacccggtcaactcgttacttctgatggcgcgagggaggc

SEQ ID NO: 3749 - DNA, 495 bp, Artificial Sequence
  source: /note="Description of Artificial Sequence: Synthetic polynucleotide"
gccttgccagcccgctcagggtcaacttaggagactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttaggagacgtcgacaccggggagctgttttttggagaaggctctaggctgaccgtactgggtaaggaggcggttggggctccggagagctccgagagggcgggatgggcagaggggtcaacttaggagacctgatggcgcgagggaggc

SEQ ID NO: 3750 - DNA, 495 bp, Artificial Sequence
  source: /note="Description of Artificial Sequence: Synthetic polynucleotide"
gccttgccagcccgctcagggtcaactgtgtctactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtgtctacgtcgacagatacgcagtattttggcccaggcacccggctgacagtgctcggtaagcgggggctcccgctgaagccccggaactggggagggggcgccccgggacgcggtcaactgtgtctacctgatggcgcgagggaggc

SEQ ID NO: 3751 - DNA, 495 bp, Artificial Sequence
  source: /note="Description of Artificial Sequence: Synthetic polynucleotide"
gccttgccagcccgctcagggtcaactgtacagtgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtacagtggtcgacaaaacattcagtacttcggcgccgggacccggctctcagtgctgggtaagctggggccgccgggggaccggggacgagactgcgctcgggtttttgtgcgggtcaactgtacagtgctgatggcgcgagggaggc

SEQ ID NO: 3752 - DNA, 495 bp, Artificial Sequence
  source: /note="Description of Artificial Sequence: Synthetic polynucleotide"
gccttgccagcccgctcagggtcaactggatcatctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactggatcatcgtcgacgagacccagtacttcgggccaggcacgcggctcctggtgctcggtgagcgcgggctgctggggcgcgggcgcgggcggcttgggtctggtttttgcggggggtcaactggatcatcctgatggcgcgagggaggc

SEQ ID NO: 3753 - DNA, 495 bp, Artificial Sequence
  source: /note="Description of Artificial Sequence: Synthetic polynucleotide"
gccttgccagcccgctcagggtcaacttattggcgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttattggcggtcgacgggccaacgtcctgactttcggggccggcagcaggctgaccgtgctgggtgagttttcgcgggaccacccgggcggcgggattcaggtggaaggcggcggggtcaacttattggcgctgatggcgcgagggaggc

SEQ ID NO: 3754 - DNA, 495 bp, Artificial Sequence
  source: /note="Description of Artificial Sequence: Synthetic polynucleotide"
gccttgccagcccgctcagggtcaactaggcttgatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaggcttgagtcgacacgagcagtacttcgggccgggcaccaggctcacggtcacaggtgagattcgggcgtctccccaccttccagcccctcggtccccggagtcggagggtggggtcaactaggcttgactgatggcgcgagggaggc

SEQ ID NO: 3755 - DNA, 495 bp, Artificial Sequence
  source: /note="Description of Artificial Sequence: Synthetic polynucleotide"
gccttgccagcccgctcaggcataactgacactctttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgacactctgtcgacactgaagctttctttggacaaggcaccagactcacagttgtaggtaagacatttttcaggttcttttgcagatccgtcacagggaaaagtgggtccacaggcataactgacactctctgatggcgcgagggaggc

SEQ ID NO: 3756 - DNA, 495 bp, Artificial Sequence
  source: /note="Description of Artificial Sequence: Synthetic polynucleotide"
gccttgccagcccgctcaggcataactttcggaacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactttcggaacgtcgactatggctacaccttcggttcggggaccaggttaaccgttgtaggtaaggctgggggtctctaggaggggtgcgatgagggaggactctgtcctgggaaatgcataactttcggaacctgatggcgcgagggaggc

SEQ ID NO: 3757 - DNA, 495 bp, Artificial Sequence
  source: /note="Description of Artificial Sequence: Synthetic polynucleotide"
gccttgccagcccgctcaggcataactaagtaacgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaagtaacggtcgacgaaacaccatatattttggagagggaagttggctcactgttgtaggtgagtaagtcaaggctggacagctgggaacttgcaaaaaggggctggaatccaggcataactaagtaacgctgatggcgcgagggaggc

SEQ ID NO: 3758 - DNA, 495 bp, Artificial Sequence
  source: /note="Description of Artificial Sequence: Synthetic polynucleotide"
gccttgccagcccgctcaggcataactgtctcctattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtctcctagtcgacaatgaaaaactgttttttggcagtggaacccagctctctgtcttgggtatgtaaaagacttctttcgggatagtgtatcataaggtcggagttccaggaggcataactgtctcctactgatggcgcgagggaggc

SEQ ID NO: 3759 - DNA, 495 bp, Artificial Sequence
  source: /note="Description of Artificial Sequence: Synthetic polynucleotide"
gccttgccagcccgctcaggcataactagagtgtcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactagagtgtcgtcgacatcagccccagcattttggtgatgggactcgactctccatcctaggtaagttgcagaatcagggtggtatggccattgtcccttgaaggcagagttctctgcataactagagtgtcctgatggcgcgagggaggc

SEQ ID NO: 3760 - DNA, 495 bp, Artificial Sequence
  source: /note="Description of Artificial Sequence: Synthetic polynucleotide"
gccttgccagcccgctcaggcataactgttccgaattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgttccgaagtcgacataattcacccctccactttgggaacgggaccaggctcactgtgacaggtatgggggctccactcttgactcgggggtgcctgggtttgactgcaatgatgcataactgttccgaactgatggcgcgagggaggc

SEQ ID NO: 3761 - DNA, 495 bp, Artificial Sequence
  source: /note="Description of Artificial Sequence: Synthetic polynucleotide"
gccttgccagcccgctcaggcataactcgttacttttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactcgttacttgtcgacacaatgagcagttcttcgggccagggacacggctcaccgtgctaggtaagaagggggctccaggtgggagagagggtgagcagcccagcctgcacgacccgcataactcgttacttctgatggcgcgagggaggc

SEQ ID NO: 3762 - DNA, 495 bp, Artificial Sequence
  source: /note="Description of Artificial Sequence: Synthetic polynucleotide"
gccttgccagcccgctcaggcataacttaggagacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttaggagacgtcgacaccggggagctgttttttggagaaggctctaggctgaccgtactgggtaaggaggcggttggggctccggagagctccgagagggcgggatgggcagagggcataacttaggagacctgatggcgcgagggaggc

SEQ ID NO: 3763 - DNA, 495 bp, Artificial Sequence
  source: /note="Description of Artificial Sequence: Synthetic polynucleotide"
gccttgccagcccgctcaggcataactgtgtctacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtgtctacgtcgacagatacgcagtattttggcccaggcacccggctgacagtgctcggtaagcgggggctcccgctgaagccccggaactggggagggggcgccccgggacgcgcataactgtgtctacctgatggcgcgagggaggc

SEQ ID NO: 3764 - DNA, 495 bp, Artificial Sequence
  source: /note="Description of Artificial Sequence: Synthetic polynucleotide"
gccttgccagcccgctcaggcataactgtacagtgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtacagtggtcgacaaaacattcagtacttcggcgccgggacccggctctcagtgctgggtaagctggggccgccgggggaccggggacgagactgcgctcgggtttttgtgcggcataactgtacagtgctgatggcgcgagggaggc

SEQ ID NO: 3765 - DNA, 495 bp, Artificial Sequence
  source: /note="Description of Artificial Sequence: Synthetic polynucleotide"
gccttgccagcccgctcaggcataactggatcatcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactggatcatcgtcgacgagacccagtacttcgggccaggcacgcggctcctggtgctcggtgagcgcgggctgctggggcgcgggcgcgggcggcttgggtctggtttttgcgggggcataactggatcatcctgatggcgcgagggaggc

SEQ ID NO: 3766 - DNA, 495 bp, Artificial Sequence
  source: /note="Description of Artificial Sequence: Synthetic polynucleotide"
gccttgccagcccgctcaggcataacttattggcgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttattggcggtcgacgggccaacgtcctgactttcggggccggcagcaggctgaccgtgctgggtgagttttcgcgggaccacccgggcggcgggattcaggtggaaggcggcgggcataacttattggcgctgatggcgcgagggaggc

SEQ ID NO: 3767 - DNA, 495 bp, Artificial Sequence
  source: /note="Description of Artificial Sequence: Synthetic polynucleotide"
gccttgccagcccgctcaggcataactaggcttgattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaggcttgagtcgacacgagcagtacttcgggccgggcaccaggctcacggtcacaggtgagattcgggcgtctccccaccttccagcccctcggtccccggagtcggagggtgggcataactaggcttgactgatggcgcgagggaggc

SEQ ID NO: 3768 - DNA, 495 bp, Artificial Sequence
  source: /note="Description of Artificial Sequence: Synthetic polynucleotide"
gccttgccagcccgctcagatatgctggacactcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggacactctgtcgacactgaagctttctttggacaaggcaccagactcacagttgtaggtaagacatttttcaggttcttttgcagatccgtcacagggaaaagtgggtccacagatatgctggacactctctgatggcgcgagggaggc

SEQ ID NO: 3769 - DNA, 495 bp, Artificial Sequence
  source: /note="Description of Artificial Sequence: Synthetic polynucleotide"
gccttgccagcccgctcagatatgctgttcggaactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgttcggaacgtcgactatggctacaccttcggttcggggaccaggttaaccgttgtaggtaaggctgggggtctctaggaggggtgcgatgagggaggactctgtcctgggaaatatatgctgttcggaacctgatggcgcgagggaggc

SEQ ID NO: 3770 - DNA, 495 bp, Artificial Sequence
  source: /note="Description of Artificial Sequence: Synthetic polynucleotide"
gccttgccagcccgctcagatatgctgaagtaacgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaagtaacggtcgacgaaacaccatatattttggagagggaagttggctcactgttgtaggtgagtaagtcaaggctggacagctgggaacttgcaaaaaggggctggaatccagatatgctgaagtaacgctgatggcgcgagggaggc

SEQ ID NO: 3771 - DNA, 495 bp, Artificial Sequence
  source: /note="Description of Artificial Sequence: Synthetic polynucleotide"
gccttgccagcccgctcagatatgctggtctcctatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtctcctagtcgacaatgaaaaactgttttttggcagtggaacccagctctctgtcttgggtatgtaaaagacttctttcgggatagtgtatcataaggtcggagttccaggagatatgctggtctcctactgatggcgcgagggaggc

SEQ ID NO: 3772 - DNA, 495 bp, Artificial Sequence
  source: /note="Description of Artificial Sequence: Synthetic polynucleotide"
gccttgccagcccgctcagatatgctgagagtgtctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgagagtgtcgtcgacatcagccccagcattttggtgatgggactcgactctccatcctaggtaagttgcagaatcagggtggtatggccattgtcccttgaaggcagagttctctatatgctgagagtgtcctgatggcgcgagggaggc

SEQ ID NO: 3773 - DNA, 495 bp, Artificial Sequence
  source: /note="Description of Artificial Sequence: Synthetic polynucleotide"
gccttgccagcccgctcagatatgctggttccgaatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggttccgaagtcgacataattcacccctccactttgggaacgggaccaggctcactgtgacaggtatgggggctccactcttgactcgggggtgcctgggtttgactgcaatgatatatgctggttccgaactgatggcgcgagggaggc

SEQ ID NO: 3774 - DNA, 495 bp, Artificial Sequence
  source: /note="Description of Artificial Sequence: Synthetic polynucleotide"
gccttgccagcccgctcagatatgctgcgttactttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgcgttacttgtcgacacaatgagcagttcttcgggccagggacacggctcaccgtgctaggtaagaagggggctccaggtgggagagagggtgagcagcccagcctgcacgacccatatgctgcgttacttctgatggcgcgagggaggc

SEQ ID NO: 3775 - DNA, 495 bp, Artificial Sequence
  source: /note="Description of Artificial Sequence: Synthetic polynucleotide"
gccttgccagcccgctcagatatgctgtaggagactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtaggagacgtcgacaccggggagctgttttttggagaaggctctaggctgaccgtactgggtaaggaggcggttggggctccggagagctccgagagggcgggatgggcagaggatatgctgtaggagacctgatggcgcgagggaggc

SEQ ID NO: 3776 - DNA, 495 bp, Artificial Sequence
  source: /note="Description of Artificial Sequence: Synthetic polynucleotide"
gccttgccagcccgctcagatatgctggtgtctactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtgtctacgtcgacagatacgcagtattttggcccaggcacccggctgacagtgctcggtaagcgggggctcccgctgaagccccggaactggggagggggcgccccgggacgcatatgctggtgtctacctgatggcgcgagggaggc

SEQ ID NO: 3777 - DNA, 495 bp, Artificial Sequence
  source: /note="Description of Artificial Sequence: Synthetic polynucleotide"
gccttgccagcccgctcagatatgctggtacagtgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtacagtggtcgacaaaacattcagtacttcggcgccgggacccggctctcagtgctgggtaagctggggccgccgggggaccggggacgagactgcgctcgggtttttgtgcgatatgctggtacagtgctgatggcgcgagggaggc

SEQ ID NO: 3778 - DNA, 495 bp, Artificial Sequence
  source: /note="Description of Artificial Sequence: Synthetic polynucleotide"
gccttgccagcccgctcagatatgctgggatcatctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgggatcatcgtcgacgagacccagtacttcgggccaggcacgcggctcctggtgctcggtgagcgcgggctgctggggcgcgggcgcgggcggcttgggtctggtttttgcggggatatgctgggatcatcctgatggcgcgagggaggc

SEQ ID NO: 3779 - DNA, 495 bp, Artificial Sequence
  source: /note="Description of Artificial Sequence: Synthetic polynucleotide"
gccttgccagcccgctcagatatgctgtattggcgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtattggcggtcgacgggccaacgtcctgactttcggggccggcagcaggctgaccgtgctgggtgagttttcgcgggaccacccgggcggcgggattcaggtggaaggcggcggatatgctgtattggcgctgatggcgcgagggaggc

SEQ ID NO: 3780 - DNA, 495 bp, Artificial Sequence
  source: /note="Description of Artificial Sequence: Synthetic polynucleotide"
gccttgccagcccgctcagatatgctgaggcttgatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaggcttgagtcgacacgagcagtacttcgggccgggcaccaggctcacggtcacaggtgagattcgggcgtctccccaccttccagcccctcggtccccggagtcggagggtggatatgctgaggcttgactgatggcgcgagggaggc

SEQ ID NO: 3781 - DNA, 495 bp, Artificial Sequence
  source: /note="Description of Artificial Sequence: Synthetic polynucleotide"
gccttgccagcccgctcagaatcctgcgacactcttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgacactctgtcgacactgaagctttctttggacaaggcaccagactcacagttgtaggtaagacatttttcaggttcttttgcagatccgtcacagggaaaagtgggtccacagaatcctgcgacactctctgatggcgcgagggaggc

SEQ ID NO: 3782 - DNA, 495 bp, Artificial Sequence
  source: /note="Description of Artificial Sequence: Synthetic polynucleotide"
gccttgccagcccgctcagaatcctgcttcggaactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcttcggaacgtcgactatggctacaccttcggttcggggaccaggttaaccgttgtaggtaaggctgggggtctctaggaggggtgcgatgagggaggactctgtcctgggaaataatcctgcttcggaacctgatggcgcgagggaggc

SEQ ID NO: 3783 - DNA, 495 bp, Artificial Sequence
  source: /note="Description of Artificial Sequence: Synthetic polynucleotide"
gccttgccagcccgctcagaatcctgcaagtaacgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaagtaacggtcgacgaaacaccatatattttggagagggaagttggctcactgttgtaggtgagtaagtcaaggctggacagctgggaacttgcaaaaaggggctggaatccagaatcctgcaagtaacgctgatggcgcgagggaggc

SEQ ID NO: 3784 - DNA, 495 bp, Artificial Sequence
  source: /note="Description of Artificial Sequence: Synthetic polynucleotide"
gccttgccagcccgctcagaatcctgcgtctcctatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtctcctagtcgacaatgaaaaactgttttttggcagtggaacccagctctctgtcttgggtatgtaaaagacttctttcgggatagtgtatcataaggtcggagttccaggagaatcctgcgtctcctactgatggcgcgagggaggc

SEQ ID NO: 3785 - DNA, 495 bp, Artificial Sequence
  source: /note="Description of Artificial Sequence: Synthetic polynucleotide"
gccttgccagcccgctcagaatcctgcagagtgtctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcagagtgtcgtcgacatcagccccagcattttggtgatgggactcgactctccatcctaggtaagttgcagaatcagggtggtatggccattgtcccttgaaggcagagttctctaatcctgcagagtgtcctgatggcgcgagggaggc

SEQ ID NO: 3786 - DNA, 495 bp, Artificial Sequence
  source: /note="Description of Artificial Sequence: Synthetic polynucleotide"
gccttgccagcccgctcagaatcctgcgttccgaatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgttccgaagtcgacataattcacccctccactttgggaacgggaccaggctcactgtgacaggtatgggggctccactcttgactcgggggtgcctgggtttgactgcaatgataatcctgcgttccgaactgatggcgcgagggaggc

SEQ ID NO: 3787 - DNA, 495 bp, Artificial Sequence
  source: /note="Description of Artificial Sequence: Synthetic polynucleotide"
gccttgccagcccgctcagaatcctgccgttactttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgccgttacttgtcgacacaatgagcagttcttcgggccagggacacggctcaccgtgctaggtaagaagggggctccaggtgggagagagggtgagcagcccagcctgcacgacccaatcctgccgttacttctgatggcgcgagggaggc

SEQ ID NO: 3788 - DNA, 495 bp, Artificial Sequence
  source: /note="Description of Artificial Sequence: Synthetic polynucleotide"
gccttgccagcccgctcagaatcctgctaggagactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctaggagacgtcgacaccggggagctgttttttggagaaggctctaggctgaccgtactgggtaaggaggcggttggggctccggagagctccgagagggcgggatgggcagaggaatcctgctaggagacctgatggcgcgagggaggc

SEQ ID NO: 3789 - DNA, 495 bp, Artificial Sequence
  source: /note="Description of Artificial Sequence: Synthetic polynucleotide"
gccttgccagcccgctcagaatcctgcgtgtctactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtgtctacgtcgacagatacgcagtattttggcccaggcacccggctgacagtgctcggtaagcgggggctcccgctgaagccccggaactggggagggggcgccccgggacgcaatcctgcgtgtctacctgatggcgcgagggaggc

SEQ ID NO: 3790 - DNA, 495 bp, Artificial Sequence
  source: /note="Description of Artificial Sequence: Synthetic polynucleotide"
gccttgccagcccgctcagaatcctgcgtacagtgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtacagtggtcgacaaaacattcagtacttcggcgccgggacccggctctcagtgctgggtaagctggggccgccgggggaccggggacgagactgcgctcgggtttttgtgcgaatcctgcgtacagtgctgatggcgcgagggaggc

SEQ ID NO: 3791 - DNA, 495 bp, Artificial Sequence
  source: /note="Description of Artificial Sequence: Synthetic polynucleotide"
gccttgccagcccgctcagaatcctgcggatcatctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcggatcatcgtcgacgagacccagtacttcgggccaggcacgcggctcctggtgctcggtgagcgcgggctgctggggcgcgggcgcgggcggcttgggtctggtttttgcggggaatcctgcggatcatcctgatggcgcgagggaggc

SEQ ID NO: 3792 - DNA, 495 bp, Artificial Sequence
  source: /note="Description of Artificial Sequence: Synthetic polynucleotide"
gccttgccagcccgctcagaatcctgctattggcgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctattggcggtcgacgggccaacgtcctgactttcggggccggcagcaggctgaccgtgctgggtgagttttcgcgggaccacccgggcggcgggattcaggtggaaggcggcggaatcctgctattggcgctgatggcgcgagggaggc

SEQ ID NO: 3793 - DNA, 495 bp, Artificial Sequence
  source: /note="Description of Artificial Sequence: Synthetic polynucleotide"
gccttgccagcccgctcagaatcctgcaggcttgatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaggcttgagtcgacacgagcagtacttcgggccgggcaccaggctcacggtcacaggtgagattcgggcgtctccccaccttccagcccctcggtccccggagtcggagggtggaatcctgcaggcttgactgatggcgcgagggaggc

SEQ ID NO: 3794 - DNA, 495 bp, Artificial Sequence
  source: /note="Description of Artificial Sequence: Synthetic polynucleotide"
gccttgccagcccgctcagtgagacctgacactctctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgacactctgtcgacactgaagctttctttggacaaggcaccagactcacagttgtaggtaagacatttttcaggttcttttgcagatccgtcacagggaaaagtgggtccacagtgagacctgacactctctgatggcgcgagggaggc

SEQ ID NO: 3795 - DNA, 495 bp, Artificial Sequence
  source: /note="Description of Artificial Sequence: Synthetic polynucleotide"
gccttgccagcccgctcagtgagacctttcggaacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctttcggaacgtcgactatggctacaccttcggttcggggaccaggttaaccgttgtaggtaaggctgggggtctctaggaggggtgcgatgagggaggactctgtcctgggaaattgagacctttcggaacctgatggcgcgagggaggc

SEQ ID NO: 3796 - DNA, 495 bp, Artificial Sequence
  source: /note="Description of Artificial Sequence: Synthetic polynucleotide"
gccttgccagcccgctcagtgagacctaagtaacgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaagtaacggtcgacgaaacaccatatattttggagagggaagttggctcactgttgtaggtgagtaagtcaaggctggacagctgggaacttgcaaaaaggggctggaatccagtgagacctaagtaacgctgatggcgcgagggaggc

SEQ ID NO: 3797 - DNA, 495 bp, Artificial Sequence
  source: /note="Description of Artificial Sequence: Synthetic polynucleotide"
gccttgccagcccgctcagtgagacctgtctcctactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtctcctagtcgacaatgaaaaactgttttttggcagtggaacccagctctctgtcttgggtatgtaaaagacttctttcgggatagtgtatcataaggtcggagttccaggagtgagacctgtctcctactgatggcgcgagggaggc

SEQ ID NO: 3798 - DNA, 495 bp, Artificial Sequence
  source: /note="Description of Artificial Sequence: Synthetic polynucleotide"
gccttgccagcccgctcagtgagacctagagtgtcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctagagtgtcgtcgacatcagccccagcattttggtgatgggactcgactctccatcctaggtaagttgcagaatcagggtggtatggccattgtcccttgaaggcagagttctcttgagacctagagtgtcctgatggcgcgagggaggc

SEQ ID NO: 3799 - DNA, 495 bp, Artificial Sequence
  source: /note="Description of Artificial Sequence: Synthetic polynucleotide"
gccttgccagcccgctcagtgagacctgttccgaactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgttccgaagtcgacataattcacccctccactttgggaacgggaccaggctcactgtgacaggtatgggggctccactcttgactcgggggtgcctgggtttgactgcaatgattgagacctgttccgaactgatggcgcgagggaggc

SEQ ID NO: 3800 - DNA, 495 bp, Artificial Sequence
  source: /note="Description of Artificial Sequence: Synthetic polynucleotide"
gccttgccagcccgctcagtgagacctcgttacttctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctcgttacttgtcgacacaatgagcagttcttcgggccagggacacggctcaccgtgctaggtaagaagggggctccaggtgggagagagggtgagcagcccagcctgcacgaccctgagacctcgttacttctgatggcgcgagggaggc

SEQ ID NO: 3801 - DNA, 495 bp, Artificial Sequence
  source: /note="Description of Artificial Sequence: Synthetic polynucleotide"
gccttgccagcccgctcagtgagaccttaggagacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttaggagacgtcgacaccggggagctgttttttggagaaggctctaggctgaccgtactgggtaaggaggcggttggggctccggagagctccgagagggcgggatgggcagaggtgagaccttaggagacctgatggcgcgagggaggc

SEQ ID NO: 3802 - DNA, 495 bp, Artificial Sequence
  source: /note="Description of Artificial Sequence: Synthetic polynucleotide"
gccttgccagcccgctcagtgagacctgtgtctacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtgtctacgtcgacagatacgcagtattttggcccaggcacccggctgacagtgctcggtaagcgggggctcccgctgaagccccggaactggggagggggcgccccgggacgctgagacctgtgtctacctgatggcgcgagggaggc

SEQ ID NO: 3803 - DNA, 495 bp, Artificial Sequence
  source: /note="Description of Artificial Sequence: Synthetic polynucleotide"
gccttgccagcccgctcagtgagacctgtacagtgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtacagtggtcgacaaaacattcagtacttcggcgccgggacccggctctcagtgctgggtaagctggggccgccgggggaccggggacgagactgcgctcgggtttttgtgcgtgagacctgtacagtgctgatggcgcgagggaggc

SEQ ID NO: 3804 - DNA, 495 bp, Artificial Sequence
  source: /note="Description of Artificial Sequence: Synthetic polynucleotide"
gccttgccagcccgctcagtgagacctggatcatcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctggatcatcgtcgacgagacccagtacttcgggccaggcacgcggctcctggtgctcggtgagcgcgggctgctggggcgcgggcgcgggcggcttgggtctggtttttgcggggtgagacctggatcatcctgatggcgcgagggaggc

SEQ ID NO: 3805 - DNA, 495 bp, Artificial Sequence
  source: /note="Description of Artificial Sequence: Synthetic polynucleotide"
gccttgccagcccgctcagtgagaccttattggcgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttattggcggtcgacgggccaacgtcctgactttcggggccggcagcaggctgaccgtgctgggtgagttttcgcgggaccacccgggcggcgggattcaggtggaaggcggcggtgagaccttattggcgctgatggcgcgagggaggc

SEQ ID NO: 3806 - DNA, 495 bp, Artificial Sequence
  source: /note="Description of Artificial Sequence: Synthetic polynucleotide"
gccttgccagcccgctcagtgagacctaggcttgactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaggcttgagtcgacacgagcagtacttcgggccgggcaccaggctcacggtcacaggtgagattcgggcgtctccccaccttccagcccctcggtccccggagtcggagggtggtgagacctaggcttgactgatggcgcgagggaggc

SEQ ID NO: 3807 - DNA, 495 bp, Artificial Sequence
  source: /note="Description of Artificial Sequence: Synthetic polynucleotide"
gccttgccagcccgctcaggaatggacgacactctttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgacactctgtcgacactgaagctttctttggacaaggcaccagactcacagttgtaggtaagacatttttcaggttcttttgcagatccgtcacagggaaaagtgggtccacaggaatggacgacactctctgatggcgcgagggaggc

SEQ ID NO: 3808 - DNA, 495 bp, Artificial Sequence
  source: /note="Description of Artificial Sequence: Synthetic polynucleotide"
gccttgccagcccgctcaggaatggacttcggaacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacttcggaacgtcgactatggctacaccttcggttcggggaccaggttaaccgttgtaggtaaggctgggggtctctaggaggggtgcgatgagggaggactctgtcctgggaaatgaatggacttcggaacctgatggcgcgagggaggc

SEQ ID NO: 3809 - DNA, 495 bp, Artificial Sequence
  source: /note="Description of Artificial Sequence: Synthetic polynucleotide"
gccttgccagcccgctcaggaatggacaagtaacgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaagtaacggtcgacgaaacaccatatattttggagagggaagttggctcactgttgtaggtgagtaagtcaaggctggacagctgggaacttgcaaaaaggggctggaatccaggaatggacaagtaacgctgatggcgcgagggaggc

SEQ ID NO: 3810 - DNA, 495 bp, Artificial Sequence
  source: /note="Description of Artificial Sequence: Synthetic polynucleotide"
gccttgccagcccgctcaggaatggacgtctcctattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtctcctagtcgacaatgaaaaactgttttttggcagtggaacccagctctctgtcttgggtatgtaaaagacttctttcgggatagtgtatcataaggtcggagttccaggaggaatggacgtctcctactgatggcgcgagggaggc

SEQ ID NO: 3811 - DNA, 495 bp, Artificial Sequence
  source: /note="Description of Artificial Sequence: Synthetic polynucleotide"
gccttgccagcccgctcaggaatggacagagtgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacagagtgtcgtcgacatcagccccagcattttggtgatgggactcgactctccatcctaggtaagttgcagaatcagggtggtatggccattgtcccttgaaggcagagttctctgaatggacagagtgtcctgatggcgcgagggaggc

SEQ ID NO: 3812 - DNA, 495 bp, Artificial Sequence
  source: /note="Description of Artificial Sequence: Synthetic polynucleotide"
gccttgccagcccgctcaggaatggacgttccgaattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgttccgaagtcgacataattcacccctccactttgggaacgggaccaggctcactgtgacaggtatgggggctccactcttgactcgggggtgcctgggtttgactgcaatgatgaatggacgttccgaactgatggcgcgagggaggc

SEQ ID NO: 3813 - DNA, 495 bp, Artificial Sequence
  source: /note="Description of Artificial Sequence: Synthetic polynucleotide"
gccttgccagcccgctcaggaatggaccgttacttttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggaccgttacttgtcgacacaatgagcagttcttcgggccagggacacggctcaccgtgctaggtaagaagggggctccaggtgggagagagggtgagcagcccagcctgcacgacccgaatggaccgttacttctgatggcgcgagggaggc

SEQ ID NO: 3814 - DNA, 495 bp, Artificial Sequence
  source: /note="Description of Artificial Sequence: Synthetic polynucleotide"
gccttgccagcccgctcaggaatggactaggagacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactaggagacgtcgacaccggggagctgttttttggagaaggctctaggctgaccgtactgggtaaggaggcggttggggctccggagagctccgagagggcgggatgggcagagggaatggactaggagacctgatggcgcgagggaggc

SEQ ID NO: 3815 - DNA, 495 bp, Artificial Sequence
  source: /note="Description of Artificial Sequence: Synthetic polynucleotide"
gccttgccagcccgctcaggaatggacgtgtctacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtgtctacgtcgacagatacgcagtattttggcccaggcacccggctgacagtgctcggtaagcgggggctcccgctgaagccccggaactggggagggggcgccccgggacgcgaatggacgtgtctacctgatggcgcgagggaggc

SEQ ID NO: 3816 - DNA, 495 bp, Artificial Sequence
  source: /note="Description of Artificial Sequence: Synthetic polynucleotide"
gccttgccagcccgctcaggaatggacgtacagtgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtacagtggtcgacaaaacattcagtacttcggcgccgggacccggctctcagtgctgggtaagctggggccgccgggggaccggggacgagactgcgctcgggtttttgtgcggaatggacgtacagtgctgatggcgcgagggaggc

SEQ ID NO: 3817 - DNA, 495 bp, Artificial Sequence
  source: /note="Description of Artificial Sequence: Synthetic polynucleotide"
gccttgccagcccgctcaggaatggacggatcatcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacggatcatcgtcgacgagacccagtacttcgggccaggcacgcggctcctggtgctcggtgagcgcgggctgctggggcgcgggcgcgggcggcttgggtctggtttttgcgggggaatggacggatcatcctgatggcgcgagggaggc

SEQ ID NO: 3818 - DNA, 495 bp, Artificial Sequence
  source: /note="Description of Artificial Sequence: Synthetic polynucleotide"
gccttgccagcccgctcaggaatggactattggcgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactattggcggtcgacgggccaacgtcctgactttcggggccggcagcaggctgaccgtgctgggtgagttttcgcgggaccacccgggcggcgggattcaggtggaaggcggcgggaatggactattggcgctgatggcgcgagggaggc

SEQ ID NO: 3819 - DNA, 495 bp, Artificial Sequence
  source: /note="Description of Artificial Sequence: Synthetic polynucleotide"
gccttgccagcccgctcaggaatggacaggcttgattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaggcttgagtcgacacgagcagtacttcgggccgggcaccaggctcacggtcacaggtgagattcgggcgtctccccaccttccagcccctcggtccccggagtcggagggtgggaatggacaggcttgactgatggcgcgagggaggc

SEQ ID NO: 3820 - DNA, 495 bp, Artificial Sequence
  source: /note="Description of Artificial Sequence: Synthetic polynucleotide"
gccttgccagcccgctcagagttatgcgacactctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgacactctgtcgacactgaagctttctttggacaaggcaccagactcacagttgtaggtaagacatttttcaggttcttttgcagatccgtcacagggaaaagtgggtccacagagttatgcgacactctctgatggcgcgagggaggc

SEQ ID NO: 3821 - DNA, 495 bp, Artificial Sequence
  source: /note="Description of Artificial Sequence: Synthetic polynucleotide"
gccttgccagcccgctcagagttatgcttcggaaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcttcggaacgtcgactatggctacaccttcggttcggggaccaggttaaccgttgtaggtaaggctgggggtctctaggaggggtgcgatgagggaggactctgtcctgggaaatagttatgcttcggaacctgatggcgcgagggaggc

SEQ ID NO: 3822 - DNA, 495 bp, Artificial Sequence
  source: /note="Description of Artificial Sequence: Synthetic polynucleotide"
gccttgccagcccgctcagagttatgcaagtaacgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaagtaacggtcgacgaaacaccatatattttggagagggaagttggctcactgttgtaggtgagtaagtcaaggctggacagctgggaacttgcaaaaaggggctggaatccagagttatgcaagtaacgctgatggcgcgagggaggc

SEQ ID NO: 3823 - DNA, 495 bp, Artificial Sequence
  source: /note="Description of Artificial Sequence: Synthetic polynucleotide"
gccttgccagcccgctcagagttatgcgtctcctacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtctcctagtcgacaatgaaaaactgttttttggcagtggaacccagctctctgtcttgggtatgtaaaagacttctttcgggatagtgtatcataaggtcggagttccaggagagttatgcgtctcctactgatggcgcgagggaggc

SEQ ID NO: 3824 - DNA, 495 bp, Artificial Sequence
  source: /note="Description of Artificial Sequence: Synthetic polynucleotide"
gccttgccagcccgctcagagttatgcagagtgtccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcagagtgtcgtcgacatcagccccagcattttggtgatgggactcgactctccatcctaggtaagttgcagaatcagggtggtatggccattgtcccttgaaggcagagttctctagttatgcagagtgtcctgatggcgcgagggaggc

SEQ ID NO: 3825 - DNA, 495 bp, Artificial Sequence
  source: /note="Description of Artificial Sequence: Synthetic polynucleotide"
gccttgccagcccgctcagagttatgcgttccgaacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgttccgaagtcgacataattcacccctccactttgggaacgggaccaggctcactgtgacaggtatgggggctccactcttgactcgggggtgcctgggtttgactgcaatgatagttatgcgttccgaactgatggcgcgagggaggc

SEQ ID NO: 3826 - DNA, 495 bp, Artificial Sequence
  source: /note="Description of Artificial Sequence: Synthetic polynucleotide"
gccttgccagcccgctcagagttatgccgttacttcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgccgttacttgtcgacacaatgagcagttcttcgggccagggacacggctcaccgtgctaggtaagaagggggctccaggtgggagagagggtgagcagcccagcctgcacgacccagttatgccgttacttctgatggcgcgagggaggc

SEQ ID NO: 3827 - DNA, 495 bp, Artificial Sequence
  source: /note="Description of Artificial Sequence: Synthetic polynucleotide"
gccttgccagcccgctcagagttatgctaggagaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctaggagacgtcgacaccggggagctgttttttggagaaggctctaggctgaccgtactgggtaaggaggcggttggggctccggagagctccgagagggcgggatgggcagaggagttatgctaggagacctgatggcgcgagggaggc

SEQ ID NO: 3828 - DNA, 495 bp, Artificial Sequence
  source: /note="Description of Artificial Sequence: Synthetic polynucleotide"
gccttgccagcccgctcagagttatgcgtgtctaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtgtctacgtcgacagatacgcagtattttggcccaggcacccggctgacagtgctcggtaagcgggggctcccgctgaagccccggaactggggagggggcgccccgggacgcagttatgcgtgtctacctgatggcgcgagggaggc

SEQ ID NO: 3829 - DNA, 495 bp, Artificial Sequence
  source: /note="Description of Artificial Sequence: Synthetic polynucleotide"
gccttgccagcccgctcagagttatgcgtacagtgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtacagtggtcgacaaaacattcagtacttcggcgccgggacccggctctcagtgctgggtaagctggggccgccgggggaccggggacgagactgcgctcgggtttttgtgcgagttatgcgtacagtgctgatggcgcgagggaggc

SEQ ID NO: 3830 - DNA, 495 bp, Artificial Sequence
  source: /note="Description of Artificial Sequence: Synthetic polynucleotide"
gccttgccagcccgctcagagttatgcggatcatccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcggatcatcgtcgacgagacccagtacttcgggccaggcacgcggctcctggtgctcggtgagcgcgggctgctggggcgcgggcgcgggcggcttgggtctggtttttgcggggagttatgcggatcatcctgatggcgcgagggaggc

SEQ ID NO: 3831 - DNA, 495 bp, Artificial Sequence
  source: /note="Description of Artificial Sequence: Synthetic polynucleotide"
gccttgccagcccgctcagagttatgctattggcgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctattggcggtcgacgggccaacgtcctgactttcggggccggcagcaggctgaccgtgctgggtgagttttcgcgggaccacccgggcggcgggattcaggtggaaggcggcggagttatgctattggcgctgatggcgcgagggaggc

SEQ ID NO: 3832 - DNA, 495 bp, Artificial Sequence
  source: /note="Description of Artificial Sequence: Synthetic polynucleotide"
gccttgccagcccgctcagagttatgcaggcttgacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaggcttgagtcgacacgagcagtacttcgggccgggcaccaggctcacggtcacaggtgagattcgggcgtctccccaccttccagcccctcggtccccggagtcggagggtggagttatgcaggcttgactgatggcgcgagggaggc

SEQ ID NO: 3833 - DNA, 495 bp, Artificial Sequence
  source: /note="Description of Artificial Sequence: Synthetic polynucleotide"
gccttgccagcccgctcagcagcatatgacactctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgacactctgtcgacactgaagctttctttggacaaggcaccagactcacagttgtaggtaagacatttttcaggttcttttgcagatccgtcacagggaaaagtgggtccacagcagcatatgacactctctgatggcgcgagggaggc

SEQ ID NO: 3834 - DNA, 495 bp, Artificial Sequence
  source: /note="Description of Artificial Sequence: Synthetic polynucleotide"
gccttgccagcccgctcagcagcatatttcggaacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatttcggaacgtcgactatggctacaccttcggttcggggaccaggttaaccgttgtaggtaaggctgggggtctctaggaggggtgcgatgagggaggactctgtcctgggaaatcagcatatttcggaacctgatggcgcgagggaggc

SEQ ID NO: 3835 - DNA, 495 bp, Artificial Sequence
  source: /note="Description of Artificial Sequence: Synthetic polynucleotide"
gccttgccagcccgctcagcagcatataagtaacgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataagtaacggtcgacgaaacaccatatattttggagagggaagttggctcactgttgtaggtgagtaagtcaaggctggacagctgggaacttgcaaaaaggggctggaatccagcagcatataagtaacgctgatggcgcgagggaggc

SEQ ID NO: 3836 - DNA, 495 bp, Artificial Sequence
  source: /note="Description of Artificial Sequence: Synthetic polynucleotide"
gccttgccagcccgctcagcagcatatgtctcctattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtctcctagtcgacaatgaaaaactgttttttggcagtggaacccagctctctgtcttgggtatgtaaaagacttctttcgggatagtgtatcataaggtcggagttccaggagcagcatatgtctcctactgatggcgcgagggaggc

SEQ ID NO: 3837 - DNA, 495 bp, Artificial Sequence
  source: /note="Description of Artificial Sequence: Synthetic polynucleotide"
gccttgccagcccgctcagcagcatatagagtgtcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatagagtgtcgtcgacatcagccccagcattttggtgatgggactcgactctccatcctaggtaagttgcagaatcagggtggtatggccattgtcccttgaaggcagagttctctcagcatatagagtgtcctgatggcgcgagggaggc

SEQ ID NO: 3838 - DNA, 495 bp, Artificial Sequence
  source: /note="Description of Artificial Sequence: Synthetic polynucleotide"
gccttgccagcccgctcagcagcatatgttccgaattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgttccgaagtcgacataattcacccctccactttgggaacgggaccaggctcactgtgacaggtatgggggctccactcttgactcgggggtgcctgggtttgactgcaatgatcagcatatgttccgaactgatggcgcgagggaggc

SEQ ID NO: 3839 - DNA, 495 bp, Artificial Sequence
  source: /note="Description of Artificial Sequence: Synthetic polynucleotide"
gccttgccagcccgctcagcagcatatcgttacttttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatcgttacttgtcgacacaatgagcagttcttcgggccagggacacggctcaccgtgctaggtaagaagggggctccaggtgggagagagggtgagcagcccagcctgcacgaccccagcatatcgttacttctgatggcgcgagggaggc

SEQ ID NO: 3840 - DNA, 495 bp, Artificial Sequence
  source: /note="Description of Artificial Sequence: Synthetic polynucleotide"
gccttgccagcccgctcagcagcatattaggagacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattaggagacgtcgacaccggggagctgttttttggagaaggctctaggctgaccgtactgggtaaggaggcggttggggctccggagagctccgagagggcgggatgggcagaggcagcatattaggagacctgatggcgcgagggaggc

SEQ ID NO: 3841 - DNA, 495 bp, Artificial Sequence
  source: /note="Description of Artificial Sequence: Synthetic polynucleotide"
gccttgccagcccgctcagcagcatatgtgtctacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtgtctacgtcgacagatacgcagtattttggcccaggcacccggctgacagtgctcggtaagcgggggctcccgctgaagccccggaactggggagggggcgccccgggacgccagcatatgtgtctacctgatggcgcgagggaggc

SEQ ID NO: 3842 - DNA, 495 bp, Artificial Sequence
  source: /note="Description of Artificial Sequence: Synthetic polynucleotide"
gccttgccagcccgctcagcagcatatgtacagtgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtacagtggtcgacaaaacattcagtacttcggcgccgggacccggctctcagtgctgggtaagctggggccgccgggggaccggggacgagactgcgctcgggtttttgtgcgcagcatatgtacagtgctgatggcgcgagggaggc

SEQ ID NO: 3843 - DNA, 495 bp, Artificial Sequence
  source: /note="Description of Artificial Sequence: Synthetic polynucleotide"
gccttgccagcccgctcagcagcatatggatcatcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatggatcatcgtcgacgagacccagtacttcgggccaggcacgcggctcctggtgctcggtgagcgcgggctgctggggcgcgggcgcgggcggcttgggtctggtttttgcggggcagcatatggatcatcctgatggcgcgagggaggc

SEQ ID NO: 3844 - DNA, 495 bp, Artificial Sequence
  source: /note="Description of Artificial Sequence: Synthetic polynucleotide"
gccttgccagcccgctcagcagcatattattggcgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattattggcggtcgacgggccaacgtcctgactttcggggccggcagcaggctgaccgtgctgggtgagttttcgcgggaccacccgggcggcgggattcaggtggaaggcggcggcagcatattattggcgctgatggcgcgagggaggc

SEQ ID NO: 3845 - DNA, 495 bp, Artificial Sequence
  source: /note="Description of Artificial Sequence: Synthetic polynucleotide"
gccttgccagcccgctcagcagcatataggcttgattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataggcttgagtcgacacgagcagtacttcgggccgggcaccaggctcacggtcacaggtgagattcgggcgtctccccaccttccagcccctcggtccccggagtcggagggtggcagcatataggcttgactgatggcgcgagggaggc

SEQ ID NO: 3846 - DNA, 495 bp, Artificial Sequence
  source: /note="Description of Artificial Sequence: Synthetic polynucleotide"
gccttgccagcccgctcaggcaggattgacactctaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgacactctgtcgacactgaagctttctttggacaaggcaccagactcacagttgtaggtaagacatttttcaggttcttttgcagatccgtcacagggaaaagtgggtccacaggcaggattgacactctctgatggcgcgagggaggc

SEQ ID NO: 3847 - DNA, 495 bp, Artificial Sequence
  source: /note="Description of Artificial Sequence: Synthetic polynucleotide"
gccttgccagcccgctcaggcaggattttcggaacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattttcggaacgtcgactatggctacaccttcggttcggggaccaggttaaccgttgtaggtaaggctgggggtctctaggaggggtgcgatgagggaggactctgtcctgggaaatgcaggattttcggaacctgatggcgcgagggaggc

SEQ ID NO: 3848 - DNA, 495 bp, Artificial Sequence
  source: /note="Description of Artificial Sequence: Synthetic polynucleotide"
gccttgccagcccgctcaggcaggattaagtaacgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaagtaacggtcgacgaaacaccatatattttggagagggaagttggctcactgttgtaggtgagtaagtcaaggctggacagctgggaacttgcaaaaaggggctggaatccaggcaggattaagtaacgctgatggcgcgagggaggc

SEQ ID NO: 3849 - DNA, 495 bp, Artificial Sequence
  source: /note="Description of Artificial Sequence: Synthetic polynucleotide"
gccttgccagcccgctcaggcaggattgtctcctaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtctcctagtcgacaatgaaaaactgttttttggcagtggaacccagctctctgtcttgggtatgtaaaagacttctttcgggatagtgtatcataaggtcggagttccaggaggcaggattgtctcctactgatggcgcgagggaggc

SEQ ID NO: 3850 - DNA, 495 bp, Artificial Sequence
  source: /note="Description of Artificial Sequence: Synthetic polynucleotide"
gccttgccagcccgctcaggcaggattagagtgtcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattagagtgtcgtcgacatcagccccagcattttggtgatgggactcgactctccatcctaggtaagttgcagaatcagggtggtatggccattgtcccttgaaggcagagttctctgcaggattagagtgtcctgatggcgcgagggaggc

SEQ ID NO: 3851 - DNA, 495 bp, Artificial Sequence
  source: /note="Description of Artificial Sequence: Synthetic polynucleotide"
gccttgccagcccgctcaggcaggattgttccgaaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgttccgaagtcgacataattcacccctccactttgggaacgggaccaggctcactgtgacaggtatgggggctccactcttgactcgggggtgcctgggtttgactgcaatgatgcaggattgttccgaactgatggcgcgagggaggc

SEQ ID NO: 3852 - DNA, 495 bp, Artificial Sequence
  source: /note="Description of Artificial Sequence: Synthetic polynucleotide"
gccttgccagcccgctcaggcaggattcgttacttaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattcgttacttgtcgacacaatgagcagttcttcgggccagggacacggctcaccgtgctaggtaagaagggggctccaggtgggagagagggtgagcagcccagcctgcacgacccgcaggattcgttacttctgatggcgcgagggaggc

SEQ ID NO: 3853 - DNA, 495 bp, Artificial Sequence
  source: /note="Description of Artificial Sequence: Synthetic polynucleotide"
gccttgccagcccgctcaggcaggatttaggagacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttaggagacgtcgacaccggggagctgttttttggagaaggctctaggctgaccgtactgggtaaggaggcggttggggctccggagagctccgagagggcgggatgggcagagggcaggatttaggagacctgatggcgcgagggaggc

SEQ ID NO: 3854 - DNA, 495 bp, Artificial Sequence
  source: /note="Description of Artificial Sequence: Synthetic polynucleotide"
gccttgccagcccgctcaggcaggattgtgtctacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtgtctacgtcgacagatacgcagtattttggcccaggcacccggctgacagtgctcggtaagcgggggctcccgctgaagccccggaactggggagggggcgccccgggacgcgcaggattgtgtctacctgatggcgcgagggaggc

SEQ ID NO: 3855 - DNA, 495 bp, Artificial Sequence
  source: /note="Description of Artificial Sequence: Synthetic polynucleotide"
gccttgccagcccgctcaggcaggattgtacagtgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtacagtggtcgacaaaacattcagtacttcggcgccgggacccggctctcagtgctgggtaagctggggccgccgggggaccggggacgagactgcgctcgggtttttgtgcggcaggattgtacagtgctgatggcgcgagggaggc

SEQ ID NO: 3856 - DNA, 495 bp, Artificial Sequence
  source: /note="Description of Artificial Sequence: Synthetic polynucleotide"
gccttgccagcccgctcaggcaggattggatcatcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattggatcatcgtcgacgagacccagtacttcgggccaggcacgcggctcctggtgctcggtgagcgcgggctgctggggcgcgggcgcgggcggcttgggtctggtttttgcgggggcaggattggatcatcctgatggcgcgagggaggc

SEQ ID NO: 3857 - DNA, 495 bp, Artificial Sequence
  source: /note="Description of Artificial Sequence: Synthetic polynucleotide"
gccttgccagcccgctcaggcaggatttattggcgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttattggcggtcgacgggccaacgtcctgactttcggggccggcagcaggctgaccgtgctgggtgagttttcgcgggaccacccgggcggcgggattcaggtggaaggcggcgggcaggatttattggcgctgatggcgcgagggaggc

SEQ ID NO: 3858 - DNA, 495 bp, Artificial Sequence
  source: /note="Description of Artificial Sequence: Synthetic polynucleotide"
gccttgccagcccgctcaggcaggattaggcttgaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaggcttgagtcgacacgagcagtacttcgggccgggcaccaggctcacggtcacaggtgagattcgggcgtctccccaccttccagcccctcggtccccggagtcggagggtgggcaggattaggcttgactgatggcgcgagggaggc

SEQ ID NO: 3859 - DNA, 495 bp, Artificial Sequence
  source: /note="Description of Artificial Sequence: Synthetic polynucleotide"
gccttgccagcccgctcagaggtctcagacactctctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagacactctgtcgacactgaagctttctttggacaaggcaccagactcacagttgtaggtaagacatttttcaggttcttttgcagatccgtcacagggaaaagtgggtccacagaggtctcagacactctctgatggcgcgagggaggc

SEQ ID NO: 3860 - DNA, 495 bp, Artificial Sequence
  source: /note="Description of Artificial Sequence: Synthetic polynucleotide"
gccttgccagcccgctcagaggtctcattcggaacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcattcggaacgtcgactatggctacaccttcggttcggggaccaggttaaccgttgtaggtaaggctgggggtctctaggaggggtgcgatgagggaggactctgtcctgggaaataggtctcattcggaacctgatggcgcgagggaggc

SEQ ID NO: 3861 - DNA, 495 bp, Artificial Sequence
  source: /note="Description of Artificial Sequence: Synthetic polynucleotide"
gccttgccagcccgctcagaggtctcaaagtaacgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaagtaacggtcgacgaaacaccatatattttggagagggaagttggctcactgttgtaggtgagtaagtcaaggctggacagctgggaacttgcaaaaaggggctggaatccagaggtctcaaagtaacgctgatggcgcgagggaggc

SEQ ID NO: 3862 - DNA, 495 bp, Artificial Sequence
  source: /note="Description of Artificial Sequence: Synthetic polynucleotide"
gccttgccagcccgctcagaggtctcagtctcctactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtctcctagtcgacaatgaaaaactgttttttggcagtggaacccagctctctgtcttgggtatgtaaaagacttctttcgggatagtgtatcataaggtcggagttccaggagaggtctcagtctcctactgatggcgcgagggaggc

SEQ ID NO: 3863 - DNA, 495 bp, Artificial Sequence
  source: /note="Description of Artificial Sequence: Synthetic polynucleotide"
gccttgccagcccgctcagaggtctcaagagtgtcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaagagtgtcgtcgacatcagccccagcattttggtgatgggactcgactctccatcctaggtaagttgcagaatcagggtggtatggccattgtcccttgaaggcagagttctctaggtctcaagagtgtcctgatggcgcgagggaggc

SEQ ID NO: 3864 - DNA, 495 bp, Artificial Sequence
  source: /note="Description of Artificial Sequence: Synthetic polynucleotide"
gccttgccagcccgctcagaggtctcagttccgaactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagttccgaagtcgacataattcacccctccactttgggaacgggaccaggctcactgtgacaggtatgggggctccactcttgactcgggggtgcctgggtttgactgcaatgataggtctcagttccgaactgatggcgcgagggaggc

SEQ ID NO: 3865 - DNA, 495 bp, Artificial Sequence
  source: /note="Description of Artificial Sequence: Synthetic polynucleotide"
gccttgccagcccgctcagaggtctcacgttacttctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcacgttacttgtcgacacaatgagcagttcttcgggccagggacacggctcaccgtgctaggtaagaagggggctccaggtgggagagagggtgagcagcccagcctgcacgacccaggtctcacgttacttctgatggcgcgagggaggc

SEQ ID NO: 3866 - DNA, 495 bp, Artificial Sequence
  source: /note="Description of Artificial Sequence: Synthetic polynucleotide"
gccttgccagcccgctcagaggtctcataggagacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcataggagacgtcgacaccggggagctgttttttggagaaggctctaggctgaccgtactgggtaaggaggcggttggggctccggagagctccgagagggcgggatgggcagaggaggtctcataggagacctgatggcgcgagggaggc

SEQ ID NO: 3867 - DNA, 495 bp, Artificial Sequence
  source: /note="Description of Artificial Sequence: Synthetic polynucleotide"
gccttgccagcccgctcagaggtctcagtgtctacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtgtctacgtcgacagatacgcagtattttggcccaggcacccggctgacagtgctcggtaagcgggggctcccgctgaagccccggaactggggagggggcgccccgggacgcaggtctcagtgtctacctgatggcgcgagggaggc

SEQ ID NO: 3868 - DNA, 495 bp, Artificial Sequence
  source: /note="Description of Artificial Sequence: Synthetic polynucleotide"
gccttgccagcccgctcagaggtctcagtacagtgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtacagtggtcgacaaaacattcagtacttcggcgccgggacccggctctcagtgctgggtaagctggggccgccgggggaccggggacgagactgcgctcgggtttttgtgcgaggtctcagtacagtgctgatggcgcgagggaggc

SEQ ID NO: 3869 - DNA, 495 bp, Artificial Sequence
  source: /note="Description of Artificial Sequence: Synthetic polynucleotide"
gccttgccagcccgctcagaggtctcaggatcatcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaggatcatcgtcgacgagacccagtacttcgggccaggcacgcggctcctggtgctcggtgagcgcgggctgctggggcgcgggcgcgggcggcttgggtctggtttttgcggggaggtctcaggatcatcctgatggcgcgagggaggc

SEQ ID NO: 3870 - DNA, 495 bp, Artificial Sequence
  source: /note="Description of Artificial Sequence: Synthetic polynucleotide"
gccttgccagcccgctcagaggtctcatattggcgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcatattggcggtcgacgggccaacgtcctgactttcggggccggcagcaggctgaccgtgctgggtgagttttcgcgggaccacccgggcggcgggattcaggtggaaggcggcggaggtctcatattggcgctgatggcgcgagggaggc

SEQ ID NO: 3871 - DNA, 495 bp, Artificial Sequence
  source: /note="Description of Artificial Sequence: Synthetic polynucleotide"
gccttgccagcccgctcagaggtctcaaggcttgactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaggcttgagtcgacacgagcagtacttcgggccgggcaccaggctcacggtcacaggtgagattcgggcgtctccccaccttccagcccctcggtccccggagtcggagggtggaggtctcaaggcttgactgatggcgcgagggaggc

SEQ ID NO: 3872 - DNA, 495 bp, Artificial Sequence
  source: /note="Description of Artificial Sequence: Synthetic polynucleotide"
gccttgccagcccgctcaggtccattcgacactctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgacactctgtcgacactgaagctttctttggacaaggcaccagactcacagttgtaggtaagacatttttcaggttcttttgcagatccgtcacagggaaaagtgggtccacaggtccattcgacactctctgatggcgcgagggaggc

SEQ ID NO: 3873 - DNA, 495 bp, Artificial Sequence
  source: /note="Description of Artificial Sequence: Synthetic polynucleotide"
gccttgccagcccgctcaggtccattcttcggaacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcttcggaacgtcgactatggctacaccttcggttcggggaccaggttaaccgttgtaggtaaggctgggggtctctaggaggggtgcgatgagggaggactctgtcctgggaaatgtccattcttcggaacctgatggcgcgagggaggc

SEQ ID NO: 3874 - DNA, 495 bp, Artificial Sequence
  source: /note="Description of Artificial Sequence: Synthetic polynucleotide"
gccttgccagcccgctcaggtccattcaagtaacgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaagtaacggtcgacgaaacaccatatattttggagagggaagttggctcactgttgtaggtgagtaagtcaaggctggacagctgggaacttgcaaaaaggggctggaatccaggtccattcaagtaacgctgatggcgcgagggaggc

SEQ ID NO: 3875 - DNA, 495 bp, Artificial Sequence
  source: /note="Description of Artificial Sequence: Synthetic polynucleotide"
gccttgccagcccgctcaggtccattcgtctcctattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtctcctagtcgacaatgaaaaactgttttttggcagtggaacccagctctctgtcttgggtatgtaaaagacttctttcgggatagtgtatcataaggtcggagttccaggaggtccattcgtctcctactgatggcgcgagggaggc

SEQ ID NO: 3876 - DNA, 495 bp, Artificial Sequence
  source: /note="Description of Artificial Sequence: Synthetic polynucleotide"
gccttgccagcccgctcaggtccattcagagtgtcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcagagtgtcgtcgacatcagccccagcattttggtgatgggactcgactctccatcctaggtaagttgcagaatcagggtggtatggccattgtcccttgaaggcagagttctctgtccattcagagtgtcctgatggcgcgagggaggc

SEQ ID NO: 3877 - DNA, 495 bp, Artificial Sequence
  source: /note="Description of Artificial Sequence: Synthetic polynucleotide"
gccttgccagcccgctcaggtccattcgttccgaattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgttccgaagtcgacataattcacccctccactttgggaacgggaccaggctcactgtgacaggtatgggggctccactcttgactcgggggtgcctgggtttgactgcaatgatgtccattcgttccgaactgatggcgcgagggaggc

SEQ ID NO: 3878 - DNA, 495 bp, Artificial Sequence
  source: /note="Description of Artificial Sequence: Synthetic polynucleotide"
gccttgccagcccgctcaggtccattccgttacttttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattccgttacttgtcgacacaatgagcagttcttcgggccagggacacggctcaccgtgctaggtaagaagggggctccaggtgggagagagggtgagcagcccagcctgcacgacccgtccattccgttacttctgatggcgcgagggaggc

SEQ ID NO: 3879 - DNA, 495 bp, Artificial Sequence
  source: /note="Description of Artificial Sequence: Synthetic polynucleotide"
gccttgccagcccgctcaggtccattctaggagacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctaggagacgtcgacaccggggagctgttttttggagaaggctctaggctgaccgtactgggtaaggaggcggttggggctccggagagctccgagagggcgggatgggcagagggtccattctaggagacctgatggcgcgagggaggc

SEQ ID NO: 3880 - DNA, 495 bp, Artificial Sequence
  source: /note="Description of Artificial Sequence: Synthetic polynucleotide"
gccttgccagcccgctcaggtccattcgtgtctacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtgtctacgtcgacagatacgcagtattttggcccaggcacccggctgacagtgctcggtaagcgggggctcccgctgaagccccggaactggggagggggcgccccgggacgcgtccattcgtgtctacctgatggcgcgagggaggc

SEQ ID NO: 3881 - DNA, 495 bp, Artificial Sequence
  source: /note="Description of Artificial Sequence: Synthetic polynucleotide"
gccttgccagcccgctcaggtccattcgtacagtgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtacagtggtcgacaaaacattcagtacttcggcgccgggacccggctctcagtgctgggtaagctggggccgccgggggaccggggacgagactgcgctcgggtttttgtgcggtccattcgtacagtgctgatggcgcgagggaggc

SEQ ID NO: 3882 - DNA, 495 bp, Artificial Sequence
  source: /note="Description of Artificial Sequence: Synthetic polynucleotide"
gccttgccagcccgctcaggtccattcggatcatcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcggatcatcgtcgacgagacccagtacttcgggccaggcacgcggctcctggtgctcggtgagcgcgggctgctggggcgcgggcgcgggcggcttgggtctggtttttgcgggggtccattcggatcatcctgatggcgcgagggaggc

SEQ ID NO: 3883 - DNA, 495 bp, Artificial Sequence
  source: /note="Description of Artificial Sequence: Synthetic polynucleotide"
gccttgccagcccgctcaggtccattctattggcgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctattggcggtcgacgggccaacgtcctgactttcggggccggcagcaggctgaccgtgctgggtgagttttcgcgggaccacccgggcggcgggattcaggtggaaggcggcgggtccattctattggcgctgatggcgcgagggaggc

SEQ ID NO: 3884 - DNA, 495 bp, Artificial Sequence
  source: /note="Description of Artificial Sequence: Synthetic polynucleotide"
gccttgccagcccgctcaggtccattcaggcttgattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaggcttgagtcgacacgagcagtacttcgggccgggcaccaggctcacggtcacaggtgagattcgggcgtctccccaccttccagcccctcggtccccggagtcggagggtgggtccattcaggcttgactgatggcgcgagggaggc

SEQ ID NO: 3885 - DNA, 495 bp, Artificial Sequence
  source: /note="Description of Artificial Sequence: Synthetic polynucleotide"
gccttgccagcccgctcagactatgacgacactcttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgacactctgtcgacactgaagctttctttggacaaggcaccagactcacagttgtaggtaagacatttttcaggttcttttgcagatccgtcacagggaaaagtgggtccacagactatgacgacactctctgatggcgcgagggaggc

SEQ ID NO: 3886 - DNA, 495 bp, Artificial Sequence
  source: /note="Description of Artificial Sequence: Synthetic polynucleotide"
gccttgccagcccgctcagactatgacttcggaactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacttcggaacgtcgactatggctacaccttcggttcggggaccaggttaaccgttgtaggtaaggctgggggtctctaggaggggtgcgatgagggaggactctgtcctgggaaatactatgacttcggaacctgatggcgcgagggaggc

SEQ ID NO: 3887 - DNA, 495 bp, Artificial Sequence
  source: /note="Description of Artificial Sequence: Synthetic polynucleotide"
gccttgccagcccgctcagactatgacaagtaacgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaagtaacggtcgacgaaacaccatatattttggagagggaagttggctcactgttgtaggtgagtaagtcaaggctggacagctgggaacttgcaaaaaggggctggaatccagactatgacaagtaacgctgatggcgcgagggaggc

SEQ ID NO: 3888 - DNA, 495 bp, Artificial Sequence
  source: /note="Description of Artificial Sequence: Synthetic polynucleotide"
gccttgccagcccgctcagactatgacgtctcctatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtctcctagtcgacaatgaaaaactgttttttggcagtggaacccagctctctgtcttgggtatgtaaaagacttctttcgggatagtgtatcataaggtcggagttccaggagactatgacgtctcctactgatggcgcgagggaggc

SEQ ID NO: 3889 - DNA, 495 bp, Artificial Sequence
  source: /note="Description of Artificial Sequence: Synthetic polynucleotide"
gccttgccagcccgctcagactatgacagagtgtctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacagagtgtcgtcgacatcagccccagcattttggtgatgggactcgactctccatcctaggtaagttgcagaatcagggtggtatggccattgtcccttgaaggcagagttctctactatgacagagtgtcctgatggcgcgagggaggc

SEQ ID NO: 3890 - DNA, 495 bp, Artificial Sequence
  source: /note="Description of Artificial Sequence: Synthetic polynucleotide"
gccttgccagcccgctcagactatgacgttccgaatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgttccgaagtcgacataattcacccctccactttgggaacgggaccaggctcactgtgacaggtatgggggctccactcttgactcgggggtgcctgggtttgactgcaatgatactatgacgttccgaactgatggcgcgagggaggc

SEQ ID NO: 3891 - DNA, 495 bp, Artificial Sequence
  source: /note="Description of Artificial Sequence: Synthetic polynucleotide"
gccttgccagcccgctcagactatgaccgttactttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgaccgttacttgtcgacacaatgagcagttcttcgggccagggacacggctcaccgtgctaggtaagaagggggctccaggtgggagagagggtgagcagcccagcctgcacgacccactatgaccgttacttctgatggcgcgagggaggc

SEQ ID NO: 3892 - DNA, 495 bp, Artificial Sequence
  source: /note="Description of Artificial Sequence: Synthetic polynucleotide"
gccttgccagcccgctcagactatgactaggagactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactaggagacgtcgacaccggggagctgttttttggagaaggctctaggctgaccgtactgggtaaggaggcggttggggctccggagagctccgagagggcgggatgggcagaggactatgactaggagacctgatggcgcgagggaggc

SEQ ID NO: 3893 - DNA, 495 bp, Artificial Sequence
  source: /note="Description of Artificial Sequence: Synthetic polynucleotide"
gccttgccagcccgctcagactatgacgtgtctactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtgtctacgtcgacagatacgcagtattttggcccaggcacccggctgacagtgctcggtaagcgggggctcccgctgaagccccggaactggggagggggcgccccgggacgcactatgacgtgtctacctgatggcgcgagggaggc

SEQ ID NO: 3894 - DNA, 495 bp, Artificial Sequence
  source: /note="Description of Artificial Sequence: Synthetic polynucleotide"
gccttgccagcccgctcagactatgacgtacagtgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtacagtggtcgacaaaacattcagtacttcggcgccgggacccggctctcagtgctgggtaagctggggccgccgggggaccggggacgagactgcgctcgggtttttgtgcgactatgacgtacagtgctgatggcgcgagggaggc

SEQ ID NO: 3895 - DNA, 495 bp, Artificial Sequence
  source: /note="Description of Artificial Sequence: Synthetic polynucleotide"
gccttgccagcccgctcagactatgacggatcatctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacggatcatcgtcgacgagacccagtacttcgggccaggcacgcggctcctggtgctcggtgagcgcgggctgctggggcgcgggcgcgggcggcttgggtctggtttttgcggggactatgacggatcatcctgatggcgcgagggaggc

SEQ ID NO: 3896 - DNA, 495 bp, Artificial Sequence
  source: /note="Description of Artificial Sequence: Synthetic polynucleotide"
gccttgccagcccgctcagactatgactattggcgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactattggcggtcgacgggccaacgtcctgactttcggggccggcagcaggctgaccgtgctgggtgagttttcgcgggaccacccgggcggcgggattcaggtggaaggcggcggactatgactattggcgctgatggcgcgagggaggc

SEQ ID NO: 3897 - DNA, 495 bp, Artificial Sequence
  source: /note="Description of Artificial Sequence: Synthetic polynucleotide"
gccttgccagcccgctcagactatgacaggcttgatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaggcttgagtcgacacgagcagtacttcgggccgggcaccaggctcacggtcacaggtgagattcgggcgtctccccaccttccagcccctcggtccccggagtcggagggtggactatgacaggcttgactgatggcgcgagggaggc

SEQ ID NO: 3898 - DNA, 495 bp, Artificial Sequence
  source: /note="Description of Artificial Sequence: Synthetic polynucleotide"
gccttgccagcccgctcagtccatgtggacactctatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggacactctgtcgacactgaagctttctttggacaaggcaccagactcacagttgtaggtaagacatttttcaggttcttttgcagatccgtcacagggaaaagtgggtccacagtccatgtggacactctctgatggcgcgagggaggc

SEQ ID NO: 3899 - DNA, 495 bp, Artificial Sequence
  source: /note="Description of Artificial Sequence: Synthetic polynucleotide"
gccttgccagcccgctcagtccatgtgttcggaacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgttcggaacgtcgactatggctacaccttcggttcggggaccaggttaaccgttgtaggtaaggctgggggtctctaggaggggtgcgatgagggaggactctgtcctgggaaattccatgtgttcggaacctgatggcgcgagggaggc

SEQ ID NO: 3900 - DNA, 495 bp, Artificial Sequence
  source: /note="Description of Artificial Sequence: Synthetic polynucleotide"
gccttgccagcccgctcagtccatgtgaagtaacgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaagtaacggtcgacgaaacaccatatattttggagagggaagttggctcactgttgtaggtgagtaagtcaaggctggacagctgggaacttgcaaaaaggggctggaatccagtccatgtgaagtaacgctgatggcgcgagggaggc

SEQ ID NO: 3901 - DNA, 495 bp, Artificial Sequence
  source: /note="Description of Artificial Sequence: Synthetic polynucleotide"
gccttgccagcccgctcagtccatgtggtctcctaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtctcctagtcgacaatgaaaaactgttttttggcagtggaacccagctctctgtcttgggtatgtaaaagacttctttcgggatagtgtatcataaggtcggagttccaggagtccatgtggtctcctactgatggcgcgagggaggc

SEQ ID NO: 3902 - DNA, 495 bp, Artificial Sequence
  source: /note="Description of Artificial Sequence: Synthetic polynucleotide"
gccttgccagcccgctcagtccatgtgagagtgtcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgagagtgtcgtcgacatcagccccagcattttggtgatgggactcgactctccatcctaggtaagttgcagaatcagggtggtatggccattgtcccttgaaggcagagttctcttccatgtgagagtgtcctgatggcgcgagggaggc

SEQ ID NO: 3903 - DNA, 495 bp, Artificial Sequence
  source: /note="Description of Artificial Sequence: Synthetic polynucleotide"
gccttgccagcccgctcagtccatgtggttccgaaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggttccgaagtcgacataattcacccctccactttgggaacgggaccaggctcactgtgacaggtatgggggctccactcttgactcgggggtgcctgggtttgactgcaatgattccatgtggttccgaactgatggcgcgagggaggc

SEQ ID NO: 3904 - DNA, 495 bp, Artificial Sequence
  source: /note="Description of Artificial Sequence: Synthetic polynucleotide"
gccttgccagcccgctcagtccatgtgcgttacttatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgcgttacttgtcgacacaatgagcagttcttcgggccagggacacggctcaccgtgctaggtaagaagggggctccaggtgggagagagggtgagcagcccagcctgcacgaccctccatgtgcgttacttctgatggcgcgagggaggc

SEQ ID NO: 3905 - DNA, 495 bp, Artificial Sequence
  source: /note="Description of Artificial Sequence: Synthetic polynucleotide"
gccttgccagcccgctcagtccatgtgtaggagacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtaggagacgtcgacaccggggagctgttttttggagaaggctctaggctgaccgtactgggtaaggaggcggttggggctccggagagctccgagagggcgggatgggcagaggtccatgtgtaggagacctgatggcgcgagggaggc

SEQ ID NO: 3906 - DNA, 495 bp, Artificial Sequence
  source: /note="Description of Artificial Sequence: Synthetic polynucleotide"
gccttgccagcccgctcagtccatgtggtgtctacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtgtctacgtcgacagatacgcagtattttggcccaggcacccggctgacagtgctcggtaagcgggggctcccgctgaagccccggaactggggagggggcgccccgggacgctccatgtggtgtctacctgatggcgcgagggaggc

SEQ ID NO: 3907 - DNA, 495 bp, Artificial Sequence
  source: /note="Description of Artificial Sequence: Synthetic polynucleotide"
gccttgccagcccgctcagtccatgtggtacagtgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtacagtggtcgacaaaacattcagtacttcggcgccgggacccggctctcagtgctgggtaagctggggccgccgggggaccggggacgagactgcgctcgggtttttgtgcgtccatgtggtacagtgctgatggcgcgagggaggc

SEQ ID NO: 3908 - DNA, 495 bp, Artificial Sequence
  source: /note="Description of Artificial Sequence: Synthetic polynucleotide"
gccttgccagcccgctcagtccatgtgggatcatcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgggatcatcgtcgacgagacccagtacttcgggccaggcacgcggctcctggtgctcggtgagcgcgggctgctggggcgcgggcgcgggcggcttgggtctggtttttgcggggtccatgtgggatcatcctgatggcgcgagggaggc

SEQ ID NO: 3909 - DNA, 495 bp, Artificial Sequence
  source: /note="Description of Artificial Sequence: Synthetic polynucleotide"
gccttgccagcccgctcagtccatgtgtattggcgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtattggcggtcgacgggccaacgtcctgactttcggggccggcagcaggctgaccgtgctgggtgagttttcgcgggaccacccgggcggcgggattcaggtggaaggcggcggtccatgtgtattggcgctgatggcgcgagggaggc

SEQ ID NO: 3910 - DNA, 495 bp, Artificial Sequence
  source: /note="Description of Artificial Sequence: Synthetic polynucleotide"
gccttgccagcccgctcagtccatgtgaggcttgaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaggcttgagtcgacacgagcagtacttcgggccgggcaccaggctcacggtcacaggtgagattcgggcgtctccccaccttccagcccctcggtccccggagtcggagggtggtccatgtgaggcttgactgatggcgcgagggaggc

SEQ ID NO: 3911 - DNA, 495 bp, Artificial Sequence
  source: /note="Description of Artificial Sequence: Synthetic polynucleotide"
gccttgccagcccgctcagatggtcaagacactcttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagacactctgtcgacactgaagctttctttggacaaggcaccagactcacagttgtaggtaagacatttttcaggttcttttgcagatccgtcacagggaaaagtgggtccacagatggtcaagacactctctgatggcgcgagggaggc

SEQ ID NO: 3912 - DNA, 495 bp, Artificial Sequence
  source: /note="Description of Artificial Sequence: Synthetic polynucleotide"
gccttgccagcccgctcagatggtcaattcggaactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaattcggaacgtcgactatggctacaccttcggttcggggaccaggttaaccgttgtaggtaaggctgggggtctctaggaggggtgcgatgagggaggactctgtcctgggaaatatggtcaattcggaacctgatggcgcgagggaggc

SEQ ID NO: 3913 - DNA, 495 bp, Artificial Sequence
  source: /note="Description of Artificial Sequence: Synthetic polynucleotide"
gccttgccagcccgctcagatggtcaaaagtaacgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaagtaacggtcgacgaaacaccatatattttggagagggaagttggctcactgttgtaggtgagtaagtcaaggctggacagctgggaacttgcaaaaaggggctggaatccagatggtcaaaagtaacgctgatggcgcgagggaggc

SEQ ID NO: 3914 - DNA, 495 bp, Artificial Sequence
  source: /note="Description of Artificial Sequence: Synthetic polynucleotide"
gccttgccagcccgctcagatggtcaagtctcctatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtctcctagtcgacaatgaaaaactgttttttggcagtggaacccagctctctgtcttgggtatgtaaaagacttctttcgggatagtgtatcataaggtcggagttccaggagatggtcaagtctcctactgatggcgcgagggaggc

SEQ ID NO: 3915 - DNA, 495 bp, Artificial Sequence
  source: /note="Description of Artificial Sequence: Synthetic polynucleotide"
gccttgccagcccgctcagatggtcaaagagtgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaagagtgtcgtcgacatcagccccagcattttggtgatgggactcgactctccatcctaggtaagttgcagaatcagggtggtatggccattgtcccttgaaggcagagttctctatggtcaaagagtgtcctgatggcgcgagggaggc

SEQ ID NO: 3916 - DNA, 495 bp, Artificial Sequence
  source: /note="Description of Artificial Sequence: Synthetic polynucleotide"
gccttgccagcccgctcagatggtcaagttccgaatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagttccgaagtcgacataattcacccctccactttgggaacgggaccaggctcactgtgacaggtatgggggctccactcttgactcgggggtgcctgggtttgactgcaatgatatggtcaagttccgaactgatggcgcgagggaggc

SEQ ID NO: 3917 - DNA, 495 bp, Artificial Sequence
  source: /note="Description of Artificial Sequence: Synthetic polynucleotide"
gccttgccagcccgctcagatggtcaacgttactttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaacgttacttgtcgacacaatgagcagttcttcgggccagggacacggctcaccgtgctaggtaagaagggggctccaggtgggagagagggtgagcagcccagcctgcacgacccatggtcaacgttacttctgatggcgcgagggaggc

SEQ ID NO: 3918 - DNA, 495 bp, Artificial Sequence
  source: /note="Description of Artificial Sequence: Synthetic polynucleotide"
gccttgccagcccgctcagatggtcaataggagactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaataggagacgtcgacaccggggagctgttttttggagaaggctctaggctgaccgtactgggtaaggaggcggttggggctccggagagctccgagagggcgggatgggcagaggatggtcaataggagacctgatggcgcgagggaggc

SEQ ID NO: 3919 - DNA, 495 bp, Artificial Sequence
  source: /note="Description of Artificial Sequence: Synthetic polynucleotide"
gccttgccagcccgctcagatggtcaagtgtctactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtgtctacgtcgacagatacgcagtattttggcccaggcacccggctgacagtgctcggtaagcgggggctcccgctgaagccccggaactggggagggggcgccccgggacgcatggtcaagtgtctacctgatggcgcgagggaggc

SEQ ID NO: 3920 - DNA, 495 bp, Artificial Sequence
  source: /note="Description of Artificial Sequence: Synthetic polynucleotide"
gccttgccagcccgctcagatggtcaagtacagtgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtacagtggtcgacaaaacattcagtacttcggcgccgggacccggctctcagtgctgggtaagctggggccgccgggggaccggggacgagactgcgctcgggtttttgtgcgatggtcaagtacagtgctgatggcgcgagggaggc

SEQ ID NO: 3921 - DNA, 495 bp, Artificial Sequence
  source: /note="Description of Artificial Sequence: Synthetic polynucleotide"
gccttgccagcccgctcagatggtcaaggatcatctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaggatcatcgtcgacgagacccagtacttcgggccaggcacgcggctcctggtgctcggtgagcgcgggctgctggggcgcgggcgcgggcggcttgggtctggtttttgcggggatggtcaaggatcatcctgatggcgcgagggaggc

SEQ ID NO: 3922 - DNA, 495 bp, Artificial Sequence
  source: /note="Description of Artificial Sequence: Synthetic polynucleotide"
gccttgccagcccgctcagatggtcaatattggcgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaatattggcggtcgacgggccaacgtcctgactttcggggccggcagcaggctgaccgtgctgggtgagttttcgcgggaccacccgggcggcgggattcaggtggaaggcggcggatggtcaatattggcgctgatggcgcgagggaggc

SEQ ID NO: 3923 - DNA, 495 bp, Artificial Sequence
  source: /note="Description of Artificial Sequence: Synthetic polynucleotide"
gccttgccagcccgctcagatggtcaaaggcttgatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaggcttgagtcgacacgagcagtacttcgggccgggcaccaggctcacggtcacaggtgagattcgggcgtctccccaccttccagcccctcggtccccggagtcggagggtggatggtcaaaggcttgactgatggcgcgagggaggc

SEQ ID NO: 3924 - DNA, 495 bp, Artificial Sequence
  source: /note="Description of Artificial Sequence: Synthetic polynucleotide"
gccttgccagcccgctcagcaagtcacgacactctccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgacactctgtcgacactgaagctttctttggacaaggcaccagactcacagttgtaggtaagacatttttcaggttcttttgcagatccgtcacagggaaaagtgggtccacagcaagtcacgacactctctgatggcgcgagggaggc

SEQ ID NO: 3925 - DNA, 495 bp, Artificial Sequence
  source: /note="Description of Artificial Sequence: Synthetic polynucleotide"
gccttgccagcccgctcagcaagtcacttcggaacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacttcggaacgtcgactatggctacaccttcggttcggggaccaggttaaccgttgtaggtaaggctgggggtctctaggaggggtgcgatgagggaggactctgtcctgggaaatcaagtcacttcggaacctgatggcgcgagggaggc

SEQ ID NO: 3926 - DNA, 495 bp, Artificial Sequence
  source: /note="Description of Artificial Sequence: Synthetic polynucleotide"
gccttgccagcccgctcagcaagtcacaagtaacgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaagtaacggtcgacgaaacaccatatattttggagagggaagttggctcactgttgtaggtgagtaagtcaaggctggacagctgggaacttgcaaaaaggggctggaatccagcaagtcacaagtaacgctgatggcgcgagggaggc

SEQ ID NO: 3927 - DNA, 495 bp, Artificial Sequence
  source: /note="Description of Artificial Sequence: Synthetic polynucleotide"
gccttgccagcccgctcagcaagtcacgtctcctaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtctcctagtcgacaatgaaaaactgttttttggcagtggaacccagctctctgtcttgggtatgtaaaagacttctttcgggatagtgtatcataaggtcggagttccaggagcaagtcacgtctcctactgatggcgcgagggaggc

SEQ ID NO: 3928 - DNA, 495 bp, Artificial Sequence
  source: /note="Description of Artificial Sequence: Synthetic polynucleotide"
gccttgccagcccgctcagcaagtcacagagtgtcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacagagtgtcgtcgacatcagccccagcattttggtgatgggactcgactctccatcctaggtaagttgcagaatcagggtggtatggccattgtcccttgaaggcagagttctctcaagtcacagagtgtcctgatggcgcgagggaggc

SEQ ID NO: 3929 - DNA, 495 bp, Artificial Sequence
  source: /note="Description of Artificial Sequence: Synthetic polynucleotide"
gccttgccagcccgctcagcaagtcacgttccgaaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgttccgaagtcgacataattcacccctccactttgggaacgggaccaggctcactgtgacaggtatgggggctccactcttgactcgggggtgcctgggtttgactgcaatgatcaagtcacgttccgaactgatggcgcgagggaggc

SEQ ID NO: 3930 - DNA, 495 bp, Artificial Sequence
  source: /note="Description of Artificial Sequence: Synthetic polynucleotide"
gccttgccagcccgctcagcaagtcaccgttacttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcaccgttacttgtcgacacaatgagcagttcttcgggccagggacacggctcaccgtgctaggtaagaagggggctccaggtgggagagagggtgagcagcccagcctgcacgaccccaagtcaccgttacttctgatggcgcgagggaggc

SEQ ID NO: 3931 - DNA, 495 bp, Artificial Sequence
  source: /note="Description of Artificial Sequence: Synthetic polynucleotide"
gccttgccagcccgctcagcaagtcactaggagacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactaggagacgtcgacaccggggagctgttttttggagaaggctctaggctgaccgtactgggtaaggaggcggttggggctccggagagctccgagagggcgggatgggcagaggcaagtcactaggagacctgatggcgcgagggaggc

SEQ ID NO: 3932 - DNA, 495 bp, Artificial Sequence
  source: /note="Description of Artificial Sequence: Synthetic polynucleotide"
gccttgccagcccgctcagcaagtcacgtgtctacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtgtctacgtcgacagatacgcagtattttggcccaggcacccggctgacagtgctcggtaagcgggggctcccgctgaagccccggaactggggagggggcgccccgggacgccaagtcacgtgtctacctgatggcgcgagggaggc

SEQ ID NO: 3933 - DNA, 495 bp, Artificial Sequence
  source: /note="Description of Artificial Sequence: Synthetic polynucleotide"
gccttgccagcccgctcagcaagtcacgtacagtgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtacagtggtcgacaaaacattcagtacttcggcgccgggacccggctctcagtgctgggtaagctggggccgccgggggaccggggacgagactgcgctcgggtttttgtgcgcaagtcacgtacagtgctgatggcgcgagggaggc

SEQ ID NO: 3934 - DNA, 495 bp, Artificial Sequence
  source: /note="Description of Artificial Sequence: Synthetic polynucleotide"
gccttgccagcccgctcagcaagtcacggatcatcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacggatcatcgtcgacgagacccagtacttcgggccaggcacgcggctcctggtgctcggtgagcgcgggctgctggggcgcgggcgcgggcggcttgggtctggtttttgcggggcaagtcacggatcatcctgatggcgcgagggaggc

SEQ ID NO: 3935 - DNA, 495 bp, Artificial Sequence
  source: /note="Description of Artificial Sequence: Synthetic polynucleotide"
gccttgccagcccgctcagcaagtcactattggcgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactattggcggtcgacgggccaacgtcctgactttcggggccggcagcaggctgaccgtgctgggtgagttttcgcgggaccacccgggcggcgggattcaggtggaaggcggcggcaagtcactattggcgctgatggcgcgagggaggc

SEQ ID NO: 3936 - DNA, 495 bp, Artificial Sequence
  source: /note="Description of Artificial Sequence: Synthetic polynucleotide"
gccttgccagcccgctcagcaagtcacaggcttgaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaggcttgagtcgacacgagcagtacttcgggccgggcaccaggctcacggtcacaggtgagattcgggcgtctccccaccttccagcccctcggtccccggagtcggagggtggcaagtcacaggcttgactgatggcgcgagggaggc

SEQ ID NO: 3937 - DNA, 495 bp, Artificial Sequence
  source: /note="Description of Artificial Sequence: Synthetic polynucleotide"
gccttgccagcccgctcaggatggcttgacactctttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgacactctgtcgacactgaagctttctttggacaaggcaccagactcacagttgtaggtaagacatttttcaggttcttttgcagatccgtcacagggaaaagtgggtccacaggatggcttgacactctctgatggcgcgagggaggc

SEQ ID NO: 3938 - DNA, 495 bp, Artificial Sequence
  source: /note="Description of Artificial Sequence: Synthetic polynucleotide"
gccttgccagcccgctcaggatggcttttcggaacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttttcggaacgtcgactatggctacaccttcggttcggggaccaggttaaccgttgtaggtaaggctgggggtctctaggaggggtgcgatgagggaggactctgtcctgggaaatgatggcttttcggaacctgatggcgcgagggaggc

SEQ ID NO: 3939 - DNA, 495 bp, Artificial Sequence
  source: /note="Description of Artificial Sequence: Synthetic polynucleotide"
gccttgccagcccgctcaggatggcttaagtaacgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaagtaacggtcgacgaaacaccatatattttggagagggaagttggctcactgttgtaggtgagtaagtcaaggctggacagctgggaacttgcaaaaaggggctggaatccaggatggcttaagtaacgctgatggcgcgagggaggc

SEQ ID NO: 3940 - DNA, 495 bp, Artificial Sequence
  source: /note="Description of Artificial Sequence: Synthetic polynucleotide"
gccttgccagcccgctcaggatggcttgtctcctattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtctcctagtcgacaatgaaaaactgttttttggcagtggaacccagctctctgtcttgggtatgtaaaagacttctttcgggatagtgtatcataaggtcggagttccaggaggatggcttgtctcctactgatggcgcgagggaggc

SEQ ID NO: 3941 - DNA, 495 bp, Artificial Sequence
  source: /note="Description of Artificial Sequence: Synthetic polynucleotide"
gccttgccagcccgctcaggatggcttagagtgtcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttagagtgtcgtcgacatcagccccagcattttggtgatgggactcgactctccatcctaggtaagttgcagaatcagggtggtatggccattgtcccttgaaggcagagttctctgatggcttagagtgtcctgatggcgcgagggaggc

SEQ ID NO: 3942 - DNA, 495 bp, Artificial Sequence
  source: /note="Description of Artificial Sequence: Synthetic polynucleotide"
gccttgccagcccgctcaggatggcttgttccgaattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgttccgaagtcgacataattcacccctccactttgggaacgggaccaggctcactgtgacaggtatgggggctccactcttgactcgggggtgcctgggtttgactgcaatgatgatggcttgttccgaactgatggcgcgagggaggc

SEQ ID NO: 3943 - DNA, 495 bp, Artificial Sequence
  source: /note="Description of Artificial Sequence: Synthetic polynucleotide"
gccttgccagcccgctcaggatggcttcgttacttttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttcgttacttgtcgacacaatgagcagttcttcgggccagggacacggctcaccgtgctaggtaagaagggggctccaggtgggagagagggtgagcagcccagcctgcacgacccgatggcttcgttacttctgatggcgcgagggaggc

SEQ ID NO: 3944 - DNA, 495 bp, Artificial Sequence
  source: /note="Description of Artificial Sequence: Synthetic polynucleotide"
gccttgccagcccgctcaggatggctttaggagacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttaggagacgtcgacaccggggagctgttttttggagaaggctctaggctgaccgtactgggtaaggaggcggttggggctccggagagctccgagagggcgggatgggcagagggatggctttaggagacctgatggcgcgagggaggc

SEQ ID NO: 3945 - DNA, 495 bp, Artificial Sequence
  source: /note="Description of Artificial Sequence: Synthetic polynucleotide"
gccttgccagcccgctcaggatggcttgtgtctacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtgtctacgtcgacagatacgcagtattttggcccaggcacccggctgacagtgctcggtaagcgggggctcccgctgaagccccggaactggggagggggcgccccgggacgcgatggcttgtgtctacctgatggcgcgagggaggc

SEQ ID NO: 3946 - DNA, 495 bp, Artificial Sequence
  source: /note="Description of Artificial Sequence: Synthetic polynucleotide"
gccttgccagcccgctcaggatggcttgtacagtgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtacagtggtcgacaaaacattcagtacttcggcgccgggacccggctctcagtgctgggtaagctggggccgccgggggaccggggacgagactgcgctcgggtttttgtgcggatggcttgtacagtgctgatggcgcgagggaggc

SEQ ID NO: 3947 - DNA, 495 bp, Artificial Sequence
  source: /note="Description of Artificial Sequence: Synthetic polynucleotide"
gccttgccagcccgctcaggatggcttggatcatcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttggatcatcgtcgacgagacccagtacttcgggccaggcacgcggctcctggtgctcggtgagcgcgggctgctggggcgcgggcgcgggcggcttgggtctggtttttgcgggggatggcttggatcatcctgatggcgcgagggaggc

SEQ ID NO: 3948 - DNA, 495 bp, Artificial Sequence
  source: /note="Description of Artificial Sequence: Synthetic polynucleotide"
gccttgccagcccgctcaggatggctttattggcgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttattggcggtcgacgggccaacgtcctgactttcggggccggcagcaggctgaccgtgctgggtgagttttcgcgggaccacccgggcggcgggattcaggtggaaggcggcgggatggctttattggcgctgatggcgcgagggaggc

SEQ ID NO: 3949 - DNA, 495 bp, Artificial Sequence
  source: /note="Description of Artificial Sequence: Synthetic polynucleotide"
gccttgccagcccgctcaggatggcttaggcttgattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaggcttgagtcgacacgagcagtacttcgggccgggcaccaggctcacggtcacaggtgagattcgggcgtctccccaccttccagcccctcggtccccggagtcggagggtgggatggcttaggcttgactgatggcgcgagggaggc

SEQ ID NO: 3950 - DNA, 495 bp, Artificial Sequence
  source: /note="Description of Artificial Sequence: Synthetic polynucleotide"
gccttgccagcccgctcagctgcaatcgacactctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgacactctgtcgacactgaagctttctttggacaaggcaccagactcacagttgtaggtaagacatttttcaggttcttttgcagatccgtcacagggaaaagtgggtccacagctgcaatcgacactctctgatggcgcgagggaggc

SEQ ID NO: 3951 - DNA, 495 bp, Artificial Sequence
  source: /note="Description of Artificial Sequence: Synthetic polynucleotide"
gccttgccagcccgctcagctgcaatcttcggaacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcttcggaacgtcgactatggctacaccttcggttcggggaccaggttaaccgttgtaggtaaggctgggggtctctaggaggggtgcgatgagggaggactctgtcctgggaaatctgcaatcttcggaacctgatggcgcgagggaggc

SEQ ID NO: 3952 - DNA, 495 bp, Artificial Sequence
  source: /note="Description of Artificial Sequence: Synthetic polynucleotide"
gccttgccagcccgctcagctgcaatcaagtaacggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaagtaacggtcgacgaaacaccatatattttggagagggaagttggctcactgttgtaggtgagtaagtcaaggctggacagctgggaacttgcaaaaaggggctggaatccagctgcaatcaagtaacgctgatggcgcgagggaggc

SEQ ID NO: 3953 - DNA, 495 bp, Artificial Sequence
  source: /note="Description of Artificial Sequence: Synthetic polynucleotide"
gccttgccagcccgctcagctgcaatcgtctcctagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtctcctagtcgacaatgaaaaactgttttttggcagtggaacccagctctctgtcttgggtatgtaaaagacttctttcgggatagtgtatcataaggtcggagttccaggagctgcaatcgtctcctactgatggcgcgagggaggc

SEQ ID NO: 3954 - DNA, 495 bp, Artificial Sequence
  source: /note="Description of Artificial Sequence: Synthetic polynucleotide"
gccttgccagcccgctcagctgcaatcagagtgtcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcagagtgtcgtcgacatcagccccagcattttggtgatgggactcgactctccatcctaggtaagttgcagaatcagggtggtatggccattgtcccttgaaggcagagttctctctgcaatcagagtgtcctgatggcgcgagggaggc

SEQ ID NO: 3955 - DNA, 495 bp, Artificial Sequence
  source: /note="Description of Artificial Sequence: Synthetic polynucleotide"
gccttgccagcccgctcagctgcaatcgttccgaagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgttccgaagtcgacataattcacccctccactttgggaacgggaccaggctcactgtgacaggtatgggggctccactcttgactcgggggtgcctgggtttgactgcaatgatctgcaatcgttccgaactgatggcgcgagggaggc

SEQ ID NO: 3956 - DNA, 495 bp, Artificial Sequence
  source: /note="Description of Artificial Sequence: Synthetic polynucleotide"
gccttgccagcccgctcagctgcaatccgttacttgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatccgttacttgtcgacacaatgagcagttcttcgggccagggacacggctcaccgtgctaggtaagaagggggctccaggtgggagagagggtgagcagcccagcctgcacgacccctgcaatccgttacttctgatggcgcgagggaggc

SEQ ID NO: 3957 - DNA, 495 bp, Artificial Sequence
  source: /note="Description of Artificial Sequence: Synthetic polynucleotide"
gccttgccagcccgctcagctgcaatctaggagacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctaggagacgtcgacaccggggagctgttttttggagaaggctctaggctgaccgtactgggtaaggaggcggttggggctccggagagctccgagagggcgggatgggcagaggctgcaatctaggagacctgatggcgcgagggaggc

SEQ ID NO: 3958 - DNA, 495 bp, Artificial Sequence
  source: /note="Description of Artificial Sequence: Synthetic polynucleotide"
gccttgccagcccgctcagctgcaatcgtgtctacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtgtctacgtcgacagatacgcagtattttggcccaggcacccggctgacagtgctcggtaagcgggggctcccgctgaagccccggaactggggagggggcgccccgggacgcctgcaatcgtgtctacctgatggcgcgagggaggc

SEQ ID NO: 3959 - DNA, 495 bp, Artificial Sequence
  source: /note="Description of Artificial Sequence: Synthetic polynucleotide"
gccttgccagcccgctcagctgcaatcgtacagtggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtacagtggtcgacaaaacattcagtacttcggcgccgggacccggctctcagtgctgggtaagctggggccgccgggggaccggggacgagactgcgctcgggtttttgtgcgctgcaatcgtacagtgctgatggcgcgagggaggc

SEQ ID NO: 3960 - DNA, 495 bp, Artificial Sequence
  source: /note="Description of Artificial Sequence: Synthetic polynucleotide"
gccttgccagcccgctcagctgcaatcggatcatcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcggatcatcgtcgacgagacccagtacttcgggccaggcacgcggctcctggtgctcggtgagcgcgggctgctggggcgcgggcgcgggcggcttgggtctggtttttgcggggctgcaatcggatcatcctgatggcgcgagggaggc

SEQ ID NO: 3961 - DNA, 495 bp, Artificial Sequence
  source: /note="Description of Artificial Sequence: Synthetic polynucleotide"
gccttgccagcccgctcagctgcaatctattggcggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctattggcggtcgacgggccaacgtcctgactttcggggccggcagcaggctgaccgtgctgggtgagttttcgcgggaccacccgggcggcgggattcaggtggaaggcggcggctgcaatctattggcgctgatggcgcgagggaggc

SEQ ID NO: 3962 - DNA, 495 bp, Artificial Sequence
  source: /note="Description of Artificial Sequence: Synthetic polynucleotide"
gccttgccagcccgctcagctgcaatcaggcttgagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaggcttgagtcgacacgagcagtacttcgggccgggcaccaggctcacggtcacaggtgagattcgggcgtctccccaccttccagcccctcggtccccggagtcggagggtggctgcaatcaggcttgactgatggcgcgagggaggc

SEQ ID NO: 3963 - DNA, 495 bp, Artificial Sequence
  source: /note="Description of Artificial Sequence: Synthetic polynucleotide"
gccttgccagcccgctcaggtcatagtgacactctactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgacactctgtcgacactgaagctttctttggacaaggcaccagactcacagttgtaggtaagacatttttcaggttcttttgcagatccgtcacagggaaaagtgggtccacaggtcatagtgacactctctgatggcgcgagggaggc

SEQ ID NO: 3964 - DNA, 495 bp, Artificial Sequence
  source: /note="Description of Artificial Sequence: Synthetic polynucleotide"
gccttgccagcccgctcaggtcatagtttcggaacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtttcggaacgtcgactatggctacaccttcggttcggggaccaggttaaccgttgtaggtaaggctgggggtctctaggaggggtgcgatgagggaggactctgtcctgggaaatgtcatagtttcggaacctgatggcgcgagggaggc

SEQ ID NO: 3965 - DNA, 495 bp, Artificial Sequence
  source: /note="Description of Artificial Sequence: Synthetic polynucleotide"
gccttgccagcccgctcaggtcatagtaagtaacgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaagtaacggtcgacgaaacaccatatattttggagagggaagttggctcactgttgtaggtgagtaagtcaaggctggacagctgggaacttgcaaaaaggggctggaatccaggtcatagtaagtaacgctgatggcgcgagggaggc

SEQ ID NO: 3966 - DNA, 495 bp, Artificial Sequence
  source: /note="Description of Artificial Sequence: Synthetic polynucleotide"
gccttgccagcccgctcaggtcatagtgtctcctaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtctcctagtcgacaatgaaaaactgttttttggcagtggaacccagctctctgtcttgggtatgtaaaagacttctttcgggatagtgtatcataaggtcggagttccaggaggtcatagtgtctcctactgatggcgcgagggaggc

SEQ ID NO: 3967 - DNA, 495 bp, Artificial Sequence
  source: /note="Description of Artificial Sequence: Synthetic polynucleotide"
gccttgccagcccgctcaggtcatagtagagtgtcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtagagtgtcgtcgacatcagccccagcattttggtgatgggactcgactctccatcctaggtaagttgcagaatcagggtggtatggccattgtcccttgaaggcagagttctctgtcatagtagagtgtcctgatggcgcgagggaggc

SEQ ID NO: 3968 - DNA, 495 bp, Artificial Sequence
  source: /note="Description of Artificial Sequence: Synthetic polynucleotide"
gccttgccagcccgctcaggtcatagtgttccgaaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgttccgaagtcgacataattcacccctccactttgggaacgggaccaggctcactgtgacaggtatgggggctccactcttgactcgggggtgcctgggtttgactgcaatgatgtcatagtgttccgaactgatggcgcgagggaggc

SEQ ID NO: 3969 - DNA, 495 bp, Artificial Sequence
  source: /note="Description of Artificial Sequence: Synthetic polynucleotide"
gccttgccagcccgctcaggtcatagtcgttacttactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtcgttacttgtcgacacaatgagcagttcttcgggccagggacacggctcaccgtgctaggtaagaagggggctccaggtgggagagagggtgagcagcccagcctgcacgacccgtcatagtcgttacttctgatggcgcgagggaggc

SEQ ID NO: 3970 - DNA, 495 bp, Artificial Sequence
  source: /note="Description of Artificial Sequence: Synthetic polynucleotide"
gccttgccagcccgctcaggtcatagttaggagacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttaggagacgtcgacaccggggagctgttttttggagaaggctctaggctgaccgtactgggtaaggaggcggttggggctccggagagctccgagagggcgggatgggcagagggtcatagttaggagacctgatggcgcgagggaggc

SEQ ID NO: 3971 - DNA, 495 bp, Artificial Sequence
  source: /note="Description of Artificial Sequence: Synthetic polynucleotide"
gccttgccagcccgctcaggtcatagtgtgtctacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtgtctacgtcgacagatacgcagtattttggcccaggcacccggctgacagtgctcggtaagcgggggctcccgctgaagccccggaactggggagggggcgccccgggacgcgtcatagtgtgtctacctgatggcgcgagggaggc

SEQ ID NO: 3972 - DNA, 495 bp, Artificial Sequence
  source: /note="Description of Artificial Sequence: Synthetic polynucleotide"
gccttgccagcccgctcaggtcatagtgtacagtgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtacagtggtcgacaaaacattcagtacttcggcgccgggacccggctctcagtgctgggtaagctggggccgccgggggaccggggacgagactgcgctcgggtttttgtgcggtcatagtgtacagtgctgatggcgcgagggaggc

SEQ ID NO: 3973 - DNA, 495 bp, Artificial Sequence
  source: /note="Description of Artificial Sequence: Synthetic polynucleotide"
gccttgccagcccgctcaggtcatagtggatcatcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtggatcatcgtcgacgagacccagtacttcgggccaggcacgcggctcctggtgctcggtgagcgcgggctgctggggcgcgggcgcgggcggcttgggtctggtttttgcgggggtcatagtggatcatcctgatggcgcgagggaggc

SEQ ID NO: 3974 - DNA, 495 bp, Artificial Sequence
  source: /note="Description of Artificial Sequence: Synthetic polynucleotide"
gccttgccagcccgctcaggtcatagttattggcgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttattggcggtcgacgggccaacgtcctgactttcggggccggcagcaggctgaccgtgctgggtgagttttcgcgggaccacccgggcggcgggattcaggtggaaggcggcgggtcatagttattggcgctgatggcgcgagggaggc

SEQ ID NO: 3975 - DNA, 495 bp, Artificial Sequence
  source: /note="Description of Artificial Sequence: Synthetic polynucleotide"
gccttgccagcccgctcaggtcatagtaggcttgaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaggcttgagtcgacacgagcagtacttcgggccgggcaccaggctcacggtcacaggtgagattcgggcgtctccccaccttccagcccctcggtccccggagtcggagggtgggtcatagtaggcttgactgatggcgcgagggaggc

SEQ ID NO: 3976 - DNA, 495 bp, Artificial Sequence
  source: /note="Description of Artificial Sequence: Synthetic polynucleotide"
gccttgccagcccgctcagcacatggagacactcttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagacactctgtcgacactgaagctttctttggacaaggcaccagactcacagttgtaggtaagacatttttcaggttcttttgcagatccgtcacagggaaaagtgggtccacagcacatggagacactctctgatggcgcgagggaggc

SEQ ID NO: 3977 - DNA, 495 bp, Artificial Sequence
  source: /note="Description of Artificial Sequence: Synthetic polynucleotide"
gccttgccagcccgctcagcacatggattcggaactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggattcggaacgtcgactatggctacaccttcggttcggggaccaggttaaccgttgtaggtaaggctgggggtctctaggaggggtgcgatgagggaggactctgtcctgggaaatcacatggattcggaacctgatggcgcgagggaggc

SEQ ID NO: 3978 - DNA, 495 bp, Artificial Sequence
  source: /note="Description of Artificial Sequence: Synthetic polynucleotide"
gccttgccagcccgctcagcacatggaaagtaacgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaagtaacggtcgacgaaacaccatatattttggagagggaagttggctcactgttgtaggtgagtaagtcaaggctggacagctgggaacttgcaaaaaggggctggaatccagcacatggaaagtaacgctgatggcgcgagggaggc

SEQ ID NO: 3979 - DNA, 495 bp, Artificial Sequence
  source: /note="Description of Artificial Sequence: Synthetic polynucleotide"
gccttgccagcccgctcagcacatggagtctcctatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtctcctagtcgacaatgaaaaactgttttttggcagtggaacccagctctctgtcttgggtatgtaaaagacttctttcgggatagtgtatcataaggtcggagttccaggagcacatggagtctcctactgatggcgcgagggaggc

SEQ ID NO: 3980 - DNA, 495 bp, Artificial Sequence
  source: /note="Description of Artificial Sequence: Synthetic polynucleotide"
gccttgccagcccgctcagcacatggaagagtgtctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaagagtgtcgtcgacatcagccccagcattttggtgatgggactcgactctccatcctaggtaagttgcagaatcagggtggtatggccattgtcccttgaaggcagagttctctcacatggaagagtgtcctgatggcgcgagggaggc

SEQ ID NO: 3981 - DNA, 495 bp, Artificial Sequence
  source: /note="Description of Artificial Sequence: Synthetic polynucleotide"
gccttgccagcccgctcagcacatggagttccgaatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagttccgaagtcgacataattcacccctccactttgggaacgggaccaggctcactgtgacaggtatgggggctccactcttgactcgggggtgcctgggtttgactgcaatgatcacatggagttccgaactgatggcgcgagggaggc

SEQ ID NO: 3982 - DNA, 495 bp, Artificial Sequence
  source: /note="Description of Artificial Sequence: Synthetic polynucleotide"
gccttgccagcccgctcagcacatggacgttactttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggacgttacttgtcgacacaatgagcagttcttcgggccagggacacggctcaccgtgctaggtaagaagggggctccaggtgggagagagggtgagcagcccagcctgcacgaccccacatggacgttacttctgatggcgcgagggaggc

SEQ ID NO: 3983 - DNA, 495 bp, Artificial Sequence
  source: /note="Description of Artificial Sequence: Synthetic polynucleotide"
gccttgccagcccgctcagcacatggataggagactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggataggagacgtcgacaccggggagctgttttttggagaaggctctaggctgaccgtactgggtaaggaggcggttggggctccggagagctccgagagggcgggatgggcagaggcacatggataggagacctgatggcgcgagggaggc

SEQ ID NO: 3984 - DNA, 495 bp, Artificial Sequence
  source: /note="Description of Artificial Sequence: Synthetic polynucleotide"
gccttgccagcccgctcagcacatggagtgtctactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtgtctacgtcgacagatacgcagtattttggcccaggcacccggctgacagtgctcggtaagcgggggctcccgctgaagccccggaactggggagggggcgccccgggacgccacatggagtgtctacctgatggcgcgagggaggc

SEQ ID NO: 3985 - DNA, 495 bp, Artificial Sequence
  source: /note="Description of Artificial Sequence: Synthetic polynucleotide"
gccttgccagcccgctcagcacatggagtacagtgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtacagtggtcgacaaaacattcagtacttcggcgccgggacccggctctcagtgctgggtaagctggggccgccgggggaccggggacgagactgcgctcgggtttttgtgcgcacatggagtacagtgctgatggcgcgagggaggc

SEQ ID NO: 3986 - DNA, 495 bp, Artificial Sequence
  source: /note="Description of Artificial Sequence: Synthetic polynucleotide"
gccttgccagcccgctcagcacatggaggatcatctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaggatcatcgtcgacgagacccagtacttcgggccaggcacgcggctcctggtgctcggtgagcgcgggctgctggggcgcgggcgcgggcggcttgggtctggtttttgcggggcacatggaggatcatcctgatggcgcgagggaggc

SEQ ID NO: 3987 - DNA, 495 bp, Artificial Sequence
  source: /note="Description of Artificial Sequence: Synthetic polynucleotide"
gccttgccagcccgctcagcacatggatattggcgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggatattggcggtcgacgggccaacgtcctgactttcggggccggcagcaggctgaccgtgctgggtgagttttcgcgggaccacccgggcggcgggattcaggtggaaggcggcggcacatggatattggcgctgatggcgcgagggaggc

SEQ ID NO: 3988 - DNA, 495 bp, Artificial Sequence
  source: /note="Description of Artificial Sequence: Synthetic polynucleotide"
gccttgccagcccgctcagcacatggaaggcttgatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaggcttgagtcgacacgagcagtacttcgggccgggcaccaggctcacggtcacaggtgagattcgggcgtctccccaccttccagcccctcggtccccggagtcggagggtggcacatggaaggcttgactgatggcgcgagggaggc

SEQ ID NO: 3989 - DNA, 495 bp, Artificial Sequence
  source: /note="Description of Artificial Sequence: Synthetic polynucleotide"
gccttgccagcccgctcagttgaccatgacactcttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgacactctgtcgacactgaagctttctttggacaaggcaccagactcacagttgtaggtaagacatttttcaggttcttttgcagatccgtcacagggaaaagtgggtccacagttgaccatgacactctctgatggcgcgagggaggc

SEQ ID NO: 3990 - DNA, 495 bp, Artificial Sequence
  source: /note="Description of Artificial Sequence: Synthetic polynucleotide"
gccttgccagcccgctcagttgaccatttcggaactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatttcggaacgtcgactatggctacaccttcggttcggggaccaggttaaccgttgtaggtaaggctgggggtctctaggaggggtgcgatgagggaggactctgtcctgggaaatttgaccatttcggaacctgatggcgcgagggaggc

SEQ ID NO: 3991 - DNA, 495 bp, Artificial Sequence
  source: /note="Description of Artificial Sequence: Synthetic polynucleotide"
gccttgccagcccgctcagttgaccataagtaacgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataagtaacggtcgacgaaacaccatatattttggagagggaagttggctcactgttgtaggtgagtaagtcaaggctggacagctgggaacttgcaaaaaggggctggaatccagttgaccataagtaacgctgatggcgcgagggaggc

SEQ ID NO: 3992 - DNA, 495 bp, Artificial Sequence
  source: /note="Description of Artificial Sequence: Synthetic polynucleotide"
gccttgccagcccgctcagttgaccatgtctcctatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtctcctagtcgacaatgaaaaactgttttttggcagtggaacccagctctctgtcttgggtatgtaaaagacttctttcgggatagtgtatcataaggtcggagttccaggagttgaccatgtctcctactgatggcgcgagggaggc

SEQ ID NO: 3993 - DNA, 495 bp, Artificial Sequence
  source: /note="Description of Artificial Sequence: Synthetic polynucleotide"
gccttgccagcccgctcagttgaccatagagtgtctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatagagtgtcgtcgacatcagccccagcattttggtgatgggactcgactctccatcctaggtaagttgcagaatcagggtggtatggccattgtcccttgaaggcagagttctctttgaccatagagtgtcctgatggcgcgagggaggc

SEQ ID NO: 3994 - DNA, 495 bp, Artificial Sequence
  source: /note="Description of Artificial Sequence: Synthetic polynucleotide"
gccttgccagcccgctcagttgaccatgttccgaatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgttccgaagtcgacataattcacccctccactttgggaacgggaccaggctcactgtgacaggtatgggggctccactcttgactcgggggtgcctgggtttgactgcaatgatttgaccatgttccgaactgatggcgcgagggaggc

SEQ ID NO: 3995 - DNA, 495 bp, Artificial Sequence
  source: /note="Description of Artificial Sequence: Synthetic polynucleotide"
gccttgccagcccgctcagttgaccatcgttactttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatcgttacttgtcgacacaatgagcagttcttcgggccagggacacggctcaccgtgctaggtaagaagggggctccaggtgggagagagggtgagcagcccagcctgcacgacccttgaccatcgttacttctgatggcgcgagggaggc

SEQ ID NO: 3996 - DNA, 495 bp, Artificial Sequence
  source: /note="Description of Artificial Sequence: Synthetic polynucleotide"
gccttgccagcccgctcagttgaccattaggagactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattaggagacgtcgacaccggggagctgttttttggagaaggctctaggctgaccgtactgggtaaggaggcggttggggctccggagagctccgagagggcgggatgggcagaggttgaccattaggagacctgatggcgcgagggaggc

SEQ ID NO: 3997 - DNA, 495 bp, Artificial Sequence
  source: /note="Description of Artificial Sequence: Synthetic polynucleotide"
gccttgccagcccgctcagttgaccatgtgtctactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtgtctacgtcgacagatacgcagtattttggcccaggcacccggctgacagtgctcggtaagcgggggctcccgctgaagccccggaactggggagggggcgccccgggacgcttgaccatgtgtctacctgatggcgcgagggaggc

SEQ ID NO: 3998 - DNA, 495 bp, Artificial Sequence
  source: /note="Description of Artificial Sequence: Synthetic polynucleotide"
gccttgccagcccgctcagttgaccatgtacagtgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtacagtggtcgacaaaacattcagtacttcggcgccgggacccggctctcagtgctgggtaagctggggccgccgggggaccggggacgagactgcgctcgggtttttgtgcgttgaccatgtacagtgctgatggcgcgagggaggc

SEQ ID NO: 3999 - DNA, 495 bp, Artificial Sequence
  source: /note="Description of Artificial Sequence: Synthetic polynucleotide"
gccttgccagcccgctcagttgaccatggatcatctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatggatcatcgtcgacgagacccagtacttcgggccaggcacgcggctcctggtgctcggtgagcgcgggctgctggggcgcgggcgcgggcggcttgggtctggtttttgcggggttgaccatggatcatcctgatggcgcgagggaggc

SEQ ID NO: 4000 - DNA, 495 bp, Artificial Sequence
  source: /note="Description of Artificial Sequence: Synthetic polynucleotide"
gccttgccagcccgctcagttgaccattattggcgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattattggcggtcgacgggccaacgtcctgactttcggggccggcagcaggctgaccgtgctgggtgagttttcgcgggaccacccgggcggcgggattcaggtggaaggcggcggttgaccattattggcgctgatggcgcgagggaggc

SEQ ID NO: 4001 - DNA, 495 bp, Artificial Sequence
  source: /note="Description of Artificial Sequence: Synthetic polynucleotide"
gccttgccagcccgctcagttgaccataggcttgatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataggcttgagtcgacacgagcagtacttcgggccgggcaccaggctcacggtcacaggtgagattcgggcgtctccccaccttccagcccctcggtccccggagtcggagggtggttgaccataggcttgactgatggcgcgagggaggc

SEQ ID NO: 4002 - DNA, 495 bp, Artificial Sequence
  source: /note="Description of Artificial Sequence: Synthetic polynucleotide"
gccttgccagcccgctcaggtgacttggacactctcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggacactctgtcgacactgaagctttctttggacaaggcaccagactcacagttgtaggtaagacatttttcaggttcttttgcagatccgtcacagggaaaagtgggtccacaggtgacttggacactctctgatggcgcgagggaggc

SEQ ID NO: 4003 - DNA, 495 bp, Artificial Sequence
  source: /note="Description of Artificial Sequence: Synthetic polynucleotide"
gccttgccagcccgctcaggtgacttgttcggaaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgttcggaacgtcgactatggctacaccttcggttcggggaccaggttaaccgttgtaggtaaggctgggggtctctaggaggggtgcgatgagggaggactctgtcctgggaaatgtgacttgttcggaacctgatggcgcgagggaggc

SEQ ID NO: 4004 - DNA, 495 bp, Artificial Sequence
  source: /note="Description of Artificial Sequence: Synthetic polynucleotide"
gccttgccagcccgctcaggtgacttgaagtaacgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaagtaacggtcgacgaaacaccatatattttggagagggaagttggctcactgttgtaggtgagtaagtcaaggctggacagctgggaacttgcaaaaaggggctggaatccaggtgacttgaagtaacgctgatggcgcgagggaggc

SEQ ID NO: 4005 - DNA, 495 bp, Artificial Sequence
  source: /note="Description of Artificial Sequence: Synthetic polynucleotide"
gccttgccagcccgctcaggtgacttggtctcctacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtctcctagtcgacaatgaaaaactgttttttggcagtggaacccagctctctgtcttgggtatgtaaaagacttctttcgggatagtgtatcataaggtcggagttccaggaggtgacttggtctcctactgatggcgcgagggaggc

SEQ ID NO: 4006 - DNA, 495 bp, Artificial Sequence
  source: /note="Description of Artificial Sequence: Synthetic polynucleotide"
gccttgccagcccgctcaggtgacttgagagtgtccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgagagtgtcgtcgacatcagccccagcattttggtgatgggactcgactctccatcctaggtaagttgcagaatcagggtggtatggccattgtcccttgaaggcagagttctctgtgacttgagagtgtcctgatggcgcgagggaggc

SEQ ID NO: 4007 - DNA, 495 bp, Artificial Sequence
  source: /note="Description of Artificial Sequence: Synthetic polynucleotide"
gccttgccagcccgctcaggtgacttggttccgaacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggttccgaagtcgacataattcacccctccactttgggaacgggaccaggctcactgtgacaggtatgggggctccactcttgactcgggggtgcctgggtttgactgcaatgatgtgacttggttccgaactgatggcgcgagggaggc

SEQ ID NO: 4008 - DNA, 495 bp, Artificial Sequence
  source: /note="Description of Artificial Sequence: Synthetic polynucleotide"
gccttgccagcccgctcaggtgacttgcgttacttcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgcgttacttgtcgacacaatgagcagttcttcgggccagggacacggctcaccgtgctaggtaagaagggggctccaggtgggagagagggtgagcagcccagcctgcacgacccgtgacttgcgttacttctgatggcgcgagggaggc

SEQ ID NO: 4009 - DNA, 495 bp, Artificial Sequence
  source: /note="Description of Artificial Sequence: Synthetic polynucleotide"
gccttgccagcccgctcaggtgacttgtaggagaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtaggagacgtcgacaccggggagctgttttttggagaaggctctaggctgaccgtactgggtaaggaggcggttggggctccggagagctccgagagggcgggatgggcagagggtgacttgtaggagacctgatggcgcgagggaggc

SEQ ID NO: 4010 - DNA, 495 bp, Artificial Sequence
  source: /note="Description of Artificial Sequence: Synthetic polynucleotide"
gccttgccagcccgctcaggtgacttggtgtctaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtgtctacgtcgacagatacgcagtattttggcccaggcacccggctgacagtgctcggtaagcgggggctcccgctgaagccccggaactggggagggggcgccccgggacgcgtgacttggtgtctacctgatggcgcgagggaggc

SEQ ID NO: 4011 - DNA, 495 bp, Artificial Sequence
  source: /note="Description of Artificial Sequence: Synthetic polynucleotide"
gccttgccagcccgctcaggtgacttggtacagtgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtacagtggtcgacaaaacattcagtacttcggcgccgggacccggctctcagtgctgggtaagctggggccgccgggggaccggggacgagactgcgctcgggtttttgtgcggtgacttggtacagtgctgatggcgcgagggaggc

SEQ ID NO: 4012 - DNA, 495 bp, Artificial Sequence
  source: /note="Description of Artificial Sequence: Synthetic polynucleotide"
gccttgccagcccgctcaggtgacttgggatcatccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgggatcatcgtcgacgagacccagtacttcgggccaggcacgcggctcctggtgctcggtgagcgcgggctgctggggcgcgggcgcgggcggcttgggtctggtttttgcgggggtgacttgggatcatcctgatggcgcgagggaggc

SEQ ID NO: 4013 - DNA, 495 bp, Artificial Sequence
  source: /note="Description of Artificial Sequence: Synthetic polynucleotide"
gccttgccagcccgctcaggtgacttgtattggcgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtattggcggtcgacgggccaacgtcctgactttcggggccggcagcaggctgaccgtgctgggtgagttttcgcgggaccacccgggcggcgggattcaggtggaaggcggcgggtgacttgtattggcgctgatggcgcgagggaggc

SEQ ID NO: 4014 - DNA, 495 bp, Artificial Sequence
  source: /note="Description of Artificial Sequence: Synthetic polynucleotide"
gccttgccagcccgctcaggtgacttgaggcttgacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaggcttgagtcgacacgagcagtacttcgggccgggcaccaggctcacggtcacaggtgagattcgggcgtctccccaccttccagcccctcggtccccggagtcggagggtgggtgacttgaggcttgactgatggcgcgagggaggc

SEQ ID NO: 4015 - DNA, 495 bp, Artificial Sequence; identical to SEQ ID NO: 1561
  source: /note="Description of Artificial Sequence: Synthetic polynucleotide"

SEQ ID NO: 4016 - DNA, 495 bp, Artificial Sequence; identical to SEQ ID NO: 1562
  source: /note="Description of Artificial Sequence: Synthetic polynucleotide"

SEQ ID NO: 4017 - DNA, 495 bp, Artificial Sequence; identical to SEQ ID NO: 1563
  source: /note="Description of Artificial Sequence: Synthetic polynucleotide"

SEQ ID NO: 4018 - DNA, 495 bp, Artificial Sequence; identical to SEQ ID NO: 1564
  source: /note="Description of Artificial Sequence: Synthetic polynucleotide"

SEQ ID NO: 4019 - DNA, 495 bp, Artificial Sequence; identical to SEQ ID NO: 1565
  source: /note="Description of Artificial Sequence: Synthetic polynucleotide"

SEQ ID NO: 4020 - DNA, 495 bp, Artificial Sequence; identical to SEQ ID NO: 1566
  source: /note="Description of Artificial Sequence: Synthetic polynucleotide"

SEQ ID NO: 4021 - DNA, 495 bp, Artificial Sequence; identical to SEQ ID NO: 1567
  source: /note="Description of Artificial Sequence: Synthetic polynucleotide"

SEQ ID NO: 4022 - DNA, 495 bp, Artificial Sequence; identical to SEQ ID NO: 1568
  source: /note="Description of Artificial Sequence: Synthetic polynucleotide"

SEQ ID NO: 4023 - DNA, 495 bp, Artificial Sequence; identical to SEQ ID NO: 1569
  source: /note="Description of Artificial Sequence: Synthetic polynucleotide"

SEQ ID NO: 4024 - DNA, 495 bp, Artificial Sequence; identical to SEQ ID NO: 1570
  source: /note="Description of Artificial Sequence: Synthetic polynucleotide"

SEQ ID NO: 4025 - DNA, 495 bp, Artificial Sequence; identical to SEQ ID NO: 1571
  source: /note="Description of Artificial Sequence: Synthetic polynucleotide"

SEQ ID NO: 4026 - DNA, 495 bp, Artificial Sequence; identical to SEQ ID NO: 1572
  source: /note="Description of Artificial Sequence: Synthetic polynucleotide"

SEQ ID NO: 4027 - DNA, 495 bp, Artificial Sequence; identical to SEQ ID NO: 1573
  source: /note="Description of Artificial Sequence: Synthetic polynucleotide"

SEQ ID NO: 4028 - DNA, 495 bp, Artificial Sequence; identical to SEQ ID NO: 1574
  source: /note="Description of Artificial Sequence: Synthetic polynucleotide"

SEQ ID NO: 4029 - DNA, 495 bp, Artificial Sequence; identical to SEQ ID NO: 1575
  source: /note="Description of Artificial Sequence: Synthetic polynucleotide"

SEQ ID NO: 4030 - DNA, 495 bp, Artificial Sequence; identical to SEQ ID NO: 1576
  source: /note="Description of Artificial Sequence: Synthetic polynucleotide"

SEQ ID NO: 4031 - DNA, 495 bp, Artificial Sequence; identical to SEQ ID NO: 1577
  source: /note="Description of Artificial Sequence: Synthetic polynucleotide"

SEQ ID NO: 4032 - DNA, 495 bp, Artificial Sequence; identical to SEQ ID NO: 1578
  source: /note="Description of Artificial Sequence: Synthetic polynucleotide"

SEQ ID NO: 4033 - DNA, 495 bp, Artificial Sequence; identical to SEQ ID NO: 1579
  source: /note="Description of Artificial Sequence: Synthetic polynucleotide"

SEQ ID NO: 4034 - DNA, 495 bp, Artificial Sequence; identical to SEQ ID NO: 1580
  source: /note="Description of Artificial Sequence: Synthetic polynucleotide"

SEQ ID NO: 4035 - DNA, 495 bp, Artificial Sequence; identical to SEQ ID NO: 1581
  source: /note="Description of Artificial Sequence: Synthetic polynucleotide"

SEQ ID NO: 4036 - DNA, 495 bp, Artificial Sequence; identical to SEQ ID NO: 1582
  source: /note="Description of Artificial Sequence: Synthetic polynucleotide"

SEQ ID NO: 4037 - DNA, 495 bp, Artificial Sequence; identical to SEQ ID NO: 1583
  source: /note="Description of Artificial Sequence: Synthetic polynucleotide"

SEQ ID NO: 4038 - DNA, 495 bp, Artificial Sequence; identical to SEQ ID NO: 1584
  source: /note="Description of Artificial Sequence: Synthetic polynucleotide"

SEQ ID NO: 4039 - DNA, 495 bp, Artificial Sequence; identical to SEQ ID NO: 1585
  source: /note="Description of Artificial Sequence: Synthetic polynucleotide"

SEQ ID NO: 4040 - DNA, 495 bp, Artificial Sequence; identical to SEQ ID NO: 1586
  source: /note="Description of Artificial Sequence: Synthetic polynucleotide"

SEQ ID NO: 4041 - DNA, 495 bp, Artificial Sequence; identical to SEQ ID NO: 1587
  source: /note="Description of Artificial Sequence: Synthetic polynucleotide"

SEQ ID NO: 4042 - DNA, 495 bp, Artificial Sequence; identical to SEQ ID NO: 1588
  source: /note="Description of Artificial Sequence: Synthetic polynucleotide"

SEQ ID NO: 4043 - DNA, 495 bp, Artificial Sequence; identical to SEQ ID NO: 1589
  source: /note="Description of Artificial Sequence: Synthetic polynucleotide"

SEQ ID NO: 4044 - DNA, 495 bp, Artificial Sequence; identical to SEQ ID NO: 1590
  source: /note="Description of Artificial Sequence: Synthetic polynucleotide"

SEQ ID NO: 4045 - DNA, 495 bp, Artificial Sequence; identical to SEQ ID NO: 1591
  source: /note="Description of Artificial Sequence: Synthetic polynucleotide"

SEQ ID NO: 4046 - DNA, 495 bp, Artificial Sequence; identical to SEQ ID NO: 1592
  source: /note="Description of Artificial Sequence: Synthetic polynucleotide"

SEQ ID NO: 4047 - DNA, 495 bp, Artificial Sequence; identical to SEQ ID NO: 1593
  source: /note="Description of Artificial Sequence: Synthetic polynucleotide"

SEQ ID NO: 4048 - DNA, 495 bp, Artificial Sequence; identical to SEQ ID NO: 1594
  source: /note="Description of Artificial Sequence: Synthetic polynucleotide"

SEQ ID NO: 4049 - DNA, 495 bp, Artificial Sequence; identical to SEQ ID NO: 1595
  source: /note="Description of Artificial Sequence: Synthetic polynucleotide"

SEQ ID NO: 4050 - DNA, 495 bp, Artificial Sequence; identical to SEQ ID NO: 1596
  source: /note="Description of Artificial Sequence: Synthetic polynucleotide"

SEQ ID NO: 4051 - DNA, 495 bp, Artificial Sequence; identical to SEQ ID NO: 1597
  source: /note="Description of Artificial Sequence: Synthetic polynucleotide"

SEQ ID NO: 4052 - DNA, 495 bp, Artificial Sequence; identical to SEQ ID NO: 1598
  source: /note="Description of Artificial Sequence: Synthetic polynucleotide"

SEQ ID NO: 4053 - DNA, 495 bp, Artificial Sequence; identical to SEQ ID NO: 1599
  source: /note="Description of Artificial Sequence: Synthetic polynucleotide"

SEQ ID NO: 4054 - DNA, 495 bp, Artificial Sequence; identical to SEQ ID NO: 1600
  source: /note="Description of Artificial Sequence: Synthetic polynucleotide"

SEQ ID NO: 4055 - DNA, 495 bp, Artificial Sequence; identical to SEQ ID NO: 1601
  source: /note="Description of Artificial Sequence: Synthetic polynucleotide"

SEQ ID NO: 4056 - DNA, 495 bp, Artificial Sequence; identical to SEQ ID NO: 1602
  source: /note="Description of Artificial Sequence: Synthetic polynucleotide"

SEQ ID NO: 4057 - DNA, 495 bp, Artificial Sequence; identical to SEQ ID NO: 1603
  source: /note="Description of Artificial Sequence: Synthetic polynucleotide"

SEQ ID NO: 4058 - DNA, 495 bp, Artificial Sequence; identical to SEQ ID NO: 1604
  source: /note="Description of Artificial Sequence: Synthetic polynucleotide"

SEQ ID NO: 4059 - DNA, 495 bp, Artificial Sequence; identical to SEQ ID NO: 1605
  source: /note="Description of Artificial Sequence: Synthetic polynucleotide"

SEQ ID NO: 4060 - DNA, 495 bp, Artificial Sequence; identical to SEQ ID NO: 1606
  source: /note="Description of Artificial Sequence: Synthetic polynucleotide"

SEQ ID NO: 4061 - DNA, 495 bp, Artificial Sequence; identical to SEQ ID NO: 1607
  source: /note="Description of Artificial Sequence: Synthetic polynucleotide"

SEQ ID NO: 4062 - DNA, 495 bp, Artificial Sequence; identical to SEQ ID NO: 1608
  source: /note="Description of Artificial Sequence: Synthetic polynucleotide"

SEQ ID NO: 4063 - DNA, 495 bp, Artificial Sequence; identical to SEQ ID NO: 1609
  source: /note="Description of Artificial Sequence: Synthetic polynucleotide"

SEQ ID NO: 4064 - DNA, 495 bp, Artificial Sequence; identical to SEQ ID NO: 1610
  source: /note="Description of Artificial Sequence: Synthetic polynucleotide"

SEQ ID NO: 4065 - DNA, 495 bp, Artificial Sequence; identical to SEQ ID NO: 1611
  source: /note="Description of Artificial Sequence: Synthetic polynucleotide"

SEQ ID NO: 4066 - DNA, 495 bp, Artificial Sequence; identical to SEQ ID NO: 1612
  source: /note="Description of Artificial Sequence: Synthetic polynucleotide"

SEQ ID NO: 4067 - DNA, 495 bp, Artificial Sequence; identical to SEQ ID NO: 1613
  source: /note="Description of Artificial Sequence: Synthetic polynucleotide"

SEQ ID NO: 4068 - DNA, 495 bp, Artificial Sequence; identical to SEQ ID NO: 1614
  source: /note="Description of Artificial Sequence: Synthetic polynucleotide"

SEQ ID NO: 4069 - DNA, 495 bp, Artificial Sequence; identical to SEQ ID NO: 1615
  source: /note="Description of Artificial Sequence: Synthetic polynucleotide"

SEQ ID NO: 4070 - DNA, 495 bp, Artificial Sequence; identical to SEQ ID NO: 1616
  source: /note="Description of Artificial Sequence: Synthetic polynucleotide"

SEQ ID NO: 4071 - DNA, 495 bp, Artificial Sequence; identical to SEQ ID NO: 1617
  source: /note="Description of Artificial Sequence: Synthetic polynucleotide"

SEQ ID NO: 4072 - DNA, 495 bp, Artificial Sequence; identical to SEQ ID NO: 1618
  source: /note="Description of Artificial Sequence: Synthetic polynucleotide"

SEQ ID NO: 4073 - DNA, 495 bp, Artificial Sequence; identical to SEQ ID NO: 1619
  source: /note="Description of Artificial Sequence: Synthetic polynucleotide"

SEQ ID NO: 4074 - DNA, 495 bp, Artificial Sequence; identical to SEQ ID NO: 1620
  source: /note="Description of Artificial Sequence: Synthetic polynucleotide"

SEQ ID NO: 4075 - DNA, 495 bp, Artificial Sequence; identical to SEQ ID NO: 1621
  source: /note="Description of Artificial Sequence: Synthetic polynucleotide"

SEQ ID NO: 4076 - DNA, 495 bp, Artificial Sequence; identical to SEQ ID NO: 1622
  source: /note="Description of Artificial Sequence: Synthetic polynucleotide"

SEQ ID NO: 4077 - DNA, 495 bp, Artificial Sequence; identical to SEQ ID NO: 1623
  source: /note="Description of Artificial Sequence: Synthetic polynucleotide"

SEQ ID NO: 4078 - DNA, 495 bp, Artificial Sequence; identical to SEQ ID NO: 1624
  source: /note="Description of Artificial Sequence: Synthetic polynucleotide"

SEQ ID NO: 4079 - DNA, 495 bp, Artificial Sequence; identical to SEQ ID NO: 1625
  source: /note="Description of Artificial Sequence: Synthetic polynucleotide"

SEQ ID NO: 4080 - DNA, 495 bp, Artificial Sequence; identical to SEQ ID NO: 1626
  source: /note="Description of Artificial Sequence: Synthetic polynucleotide"

SEQ ID NO: 4081 - DNA, 495 bp, Artificial Sequence; identical to SEQ ID NO: 1627
  source: /note="Description of Artificial Sequence: Synthetic polynucleotide"

SEQ ID NO: 4082 - DNA, 495 bp, Artificial Sequence; identical to SEQ ID NO: 1628
  source: /note="Description of Artificial Sequence: Synthetic polynucleotide"

SEQ ID NO: 4083 - DNA, 495 bp, Artificial Sequence; identical to SEQ ID NO: 1629
  source: /note="Description of Artificial Sequence: Synthetic polynucleotide"

SEQ ID NO: 4084 - DNA, 495 bp, Artificial Sequence; identical to SEQ ID NO: 1630
  source: /note="Description of Artificial Sequence: Synthetic polynucleotide"

SEQ ID NO: 4085 - DNA, 495 bp, Artificial Sequence; identical to SEQ ID NO: 1805
  source: /note="Description of Artificial Sequence: Synthetic polynucleotide"

SEQ ID NO: 4086 - DNA, 495 bp, Artificial Sequence; identical to SEQ ID NO: 1806
  source: /note="Description of Artificial Sequence: Synthetic polynucleotide"

SEQ ID NO: 4087 - DNA, 495 bp, Artificial Sequence; identical to SEQ ID NO: 1807
  source: /note="Description of Artificial Sequence: Synthetic polynucleotide"

SEQ ID NO: 4088 - DNA, 495 bp, Artificial Sequence; identical to SEQ ID NO: 1808
  source: /note="Description of Artificial Sequence: Synthetic polynucleotide"

SEQ ID NO: 4089 - DNA, 495 bp, Artificial Sequence; identical to SEQ ID NO: 1809
  source: /note="Description of Artificial Sequence: Synthetic polynucleotide"

SEQ ID NO: 4090 - DNA, 495 bp, Artificial Sequence; identical to SEQ ID NO: 1810
  source: /note="Description of Artificial Sequence: Synthetic polynucleotide"

SEQ ID NO: 4091 - DNA, 495 bp, Artificial Sequence; identical to SEQ ID NO: 1811
  source: /note="Description of Artificial Sequence: Synthetic polynucleotide"

SEQ ID NO: 4092 - DNA, 495 bp, Artificial Sequence; identical to SEQ ID NO: 1812
  source: /note="Description of Artificial Sequence: Synthetic polynucleotide"

SEQ ID NO: 4093 - DNA, 495 bp, Artificial Sequence; identical to SEQ ID NO: 1813
  source: /note="Description of Artificial Sequence: Synthetic polynucleotide"

SEQ ID NO: 4094 - DNA, 495 bp, Artificial Sequence; identical to SEQ ID NO: 1814
  source: /note="Description of Artificial Sequence: Synthetic polynucleotide"

SEQ ID NO: 4095 - DNA, 495 bp, Artificial Sequence; identical to SEQ ID NO: 1815
  source: /note="Description of Artificial Sequence: Synthetic polynucleotide"

SEQ ID NO: 4096 - DNA, 495 bp, Artificial Sequence; identical to SEQ ID NO: 1816
  source: /note="Description of Artificial Sequence: Synthetic polynucleotide"

SEQ ID NO: 4097 - DNA, 495 bp, Artificial Sequence; identical to SEQ ID NO: 1817
  source: /note="Description of Artificial Sequence: Synthetic polynucleotide"

SEQ ID NO: 4098 - DNA, 495 bp, Artificial Sequence; identical to SEQ ID NO: 1818
  source: /note="Description of Artificial Sequence: Synthetic polynucleotide"

SEQ ID NO: 4099 - DNA, 495 bp, Artificial Sequence; identical to SEQ ID NO: 1819
  source: /note="Description of Artificial Sequence: Synthetic polynucleotide"

SEQ ID NO: 4100 - DNA, 495 bp, Artificial Sequence; identical to SEQ ID NO: 1820
  source: /note="Description of Artificial Sequence: Synthetic polynucleotide"

SEQ ID NO: 4101 - DNA, 495 bp, Artificial Sequence; identical to SEQ ID NO: 1821
  source: /note="Description of Artificial Sequence: Synthetic polynucleotide"

SEQ ID NO: 4102 - DNA, 495 bp, Artificial Sequence; identical to SEQ ID NO: 1822
  source: /note="Description of Artificial Sequence: Synthetic polynucleotide"

SEQ ID NO: 4103 - DNA, 495 bp, Artificial Sequence; identical to SEQ ID NO: 1823
  source: /note="Description of Artificial Sequence: Synthetic polynucleotide"

SEQ ID NO: 4104 - DNA, 495 bp, Artificial Sequence; identical to SEQ ID NO: 1824
  source: /note="Description of Artificial Sequence: Synthetic polynucleotide"

SEQ ID NO: 4105 - DNA, 495 bp, Artificial Sequence; identical to SEQ ID NO: 1825
  source: /note="Description of Artificial Sequence: Synthetic polynucleotide"

SEQ ID NO: 4106 - DNA, 495 bp, Artificial Sequence; identical to SEQ ID NO: 1826
  source: /note="Description of Artificial Sequence: Synthetic polynucleotide"

SEQ ID NO: 4107 - DNA, 495 bp, Artificial Sequence; identical to SEQ ID NO: 1827
  source: /note="Description of Artificial Sequence: Synthetic polynucleotide"

SEQ ID NO: 4108 - DNA, 495 bp, Artificial Sequence; identical to SEQ ID NO: 1828
  source: /note="Description of Artificial Sequence: Synthetic polynucleotide"

SEQ ID NO: 4109 - DNA, 495 bp, Artificial Sequence; identical to SEQ ID NO: 1829
  source: /note="Description of Artificial Sequence: Synthetic polynucleotide"

SEQ ID NO: 4110 - DNA, 495 bp, Artificial Sequence; identical to SEQ ID NO: 1830
  source: /note="Description of Artificial Sequence: Synthetic polynucleotide"

SEQ ID NO: 4111 - DNA, 495 bp, Artificial Sequence; identical to SEQ ID NO: 1831
  source: /note="Description of Artificial Sequence: Synthetic polynucleotide"

SEQ ID NO: 4112 - DNA, 495 bp, Artificial Sequence; identical to SEQ ID NO: 1832
  source: /note="Description of Artificial Sequence: Synthetic polynucleotide"

SEQ ID NO: 4113 - DNA, 495 bp, Artificial Sequence; identical to SEQ ID NO: 1833
  source: /note="Description of Artificial Sequence: Synthetic polynucleotide"

SEQ ID NO: 4114 - DNA, 495 bp, Artificial Sequence; identical to SEQ ID NO: 1834
  source: /note="Description of Artificial Sequence: Synthetic polynucleotide"

SEQ ID NO: 4115 - DNA, 495 bp, Artificial Sequence; identical to SEQ ID NO: 1835
  source: /note="Description of Artificial Sequence: Synthetic polynucleotide"

SEQ ID NO: 4116 - DNA, 495 bp, Artificial Sequence; identical to SEQ ID NO: 1836
  source: /note="Description of Artificial Sequence: Synthetic polynucleotide"

SEQ ID NO: 4117 - DNA, 495 bp, Artificial Sequence; identical to SEQ ID NO: 1837
  source: /note="Description of Artificial Sequence: Synthetic polynucleotide"

SEQ ID NO: 4118 - DNA, 495 bp, Artificial Sequence; identical to SEQ ID NO: 1838
  source: /note="Description of Artificial Sequence: Synthetic polynucleotide"

SEQ ID NO: 4119 - DNA, 495 bp, Artificial Sequence; identical to SEQ ID NO: 1839
  source: /note="Description of Artificial Sequence: Synthetic polynucleotide"

SEQ ID NO: 4120 - DNA, 495 bp, Artificial Sequence; identical to SEQ ID NO: 1840
  source: /note="Description of Artificial Sequence: Synthetic polynucleotide"

SEQ ID NO: 4121 - DNA, 495 bp, Artificial Sequence; identical to SEQ ID NO: 1841
  source: /note="Description of Artificial Sequence: Synthetic polynucleotide"

SEQ ID NO: 4122 - DNA, 495 bp, Artificial Sequence; identical to SEQ ID NO: 1842
  source: /note="Description of Artificial Sequence: Synthetic polynucleotide"

SEQ ID NO: 4123 - DNA, 495 bp, Artificial Sequence; identical to SEQ ID NO: 1843
  source: /note="Description of Artificial Sequence: Synthetic polynucleotide"

SEQ ID NO: 4124 - DNA, 495 bp, Artificial Sequence; identical to SEQ ID NO: 1844
  source: /note="Description of Artificial Sequence: Synthetic polynucleotide"

SEQ ID NO: 4125 - DNA, 495 bp, Artificial Sequence; identical to SEQ ID NO: 1845
  source: /note="Description of Artificial Sequence: Synthetic polynucleotide"

SEQ ID NO: 4126 - DNA, 495 bp, Artificial Sequence; identical to SEQ ID NO: 1846
  source: /note="Description of Artificial Sequence: Synthetic polynucleotide"

SEQ ID NO: 4127 - DNA, 495 bp, Artificial Sequence; identical to SEQ ID NO: 1847
  source: /note="Description of Artificial Sequence: Synthetic polynucleotide"

SEQ ID NO: 4128 - DNA, 495 bp, Artificial Sequence; identical to SEQ ID NO: 1848
  source: /note="Description of Artificial Sequence: Synthetic polynucleotide"

SEQ ID NO: 4129 - DNA, 495 bp, Artificial Sequence; identical to SEQ ID NO: 1849
  source: /note="Description of Artificial Sequence: Synthetic polynucleotide"

SEQ ID NO: 4130 - DNA, 495 bp, Artificial Sequence; identical to SEQ ID NO: 1850
  source: /note="Description of Artificial Sequence: Synthetic polynucleotide"

SEQ ID NO: 4131 - DNA, 495 bp, Artificial Sequence; identical to SEQ ID NO: 1851
  source: /note="Description of Artificial Sequence: Synthetic polynucleotide"

SEQ ID NO: 4132 - DNA, 495 bp, Artificial Sequence; identical to SEQ ID NO: 1852
  source: /note="Description of Artificial Sequence: Synthetic polynucleotide"

SEQ ID NO: 4133 - DNA, 495 bp, Artificial Sequence; identical to SEQ ID NO: 1853
  source: /note="Description of Artificial Sequence: Synthetic polynucleotide"

SEQ ID NO: 4134 - DNA, 495 bp, Artificial Sequence; identical to SEQ ID NO: 1854
  source: /note="Description of Artificial Sequence: Synthetic polynucleotide"

SEQ ID NO: 4135 - DNA, 495 bp, Artificial Sequence; identical to SEQ ID NO: 1855
  source: /note="Description of Artificial Sequence: Synthetic polynucleotide"

SEQ ID NO: 4136 - DNA, 495 bp, Artificial Sequence; identical to SEQ ID NO: 1856
  source: /note="Description of Artificial Sequence: Synthetic polynucleotide"

SEQ ID NO: 4137 - DNA, 495 bp, Artificial Sequence; identical to SEQ ID NO: 1857
  source: /note="Description of Artificial Sequence: Synthetic polynucleotide"

SEQ ID NO: 4138 - DNA, 495 bp, Artificial Sequence; identical to SEQ ID NO: 1858
  source: /note="Description of Artificial Sequence: Synthetic polynucleotide"

SEQ ID NO: 4139 - DNA, 495 bp, Artificial Sequence; identical to SEQ ID NO: 1859
  source: /note="Description of Artificial Sequence: Synthetic polynucleotide"

SEQ ID NO: 4140 - DNA, 495 bp, Artificial Sequence; identical to SEQ ID NO: 1860
  source: /note="Description of Artificial Sequence: Synthetic polynucleotide"

SEQ ID NO: 4141 - DNA, 495 bp, Artificial Sequence; identical to SEQ ID NO: 1861
  source: /note="Description of Artificial Sequence: Synthetic polynucleotide"

SEQ ID NO: 4142 - DNA, 495 bp, Artificial Sequence; identical to SEQ ID NO: 1862
  source: /note="Description of Artificial Sequence: Synthetic polynucleotide"

SEQ ID NO: 4143 - DNA, 495 bp, Artificial Sequence; identical to SEQ ID NO: 1863
  source: /note="Description of Artificial Sequence: Synthetic polynucleotide"

SEQ ID NO: 4144 - DNA, 495 bp, Artificial Sequence; identical to SEQ ID NO: 1864
  source: /note="Description of Artificial Sequence: Synthetic polynucleotide"

SEQ ID NO: 4145 - DNA, 495 bp, Artificial Sequence; identical to SEQ ID NO: 1865
  source: /note="Description of Artificial Sequence: Synthetic polynucleotide"

SEQ ID NO: 4146 - DNA, 495 bp, Artificial Sequence; identical to SEQ ID NO: 1866
  source: /note="Description of Artificial Sequence: Synthetic polynucleotide"

SEQ ID NO: 4147 - DNA, 495 bp, Artificial Sequence; identical to SEQ ID NO: 1867
  source: /note="Description of Artificial Sequence: Synthetic polynucleotide"

SEQ ID NO: 4148 - DNA, 495 bp, Artificial Sequence; identical to SEQ ID NO: 1868
  source: /note="Description of Artificial Sequence: Synthetic polynucleotide"

SEQ ID NO: 4149 - DNA, 495 bp, Artificial Sequence; identical to SEQ ID NO: 1869
  source: /note="Description of Artificial Sequence: Synthetic polynucleotide"

SEQ ID NO: 4150 - DNA, 495 bp, Artificial Sequence; identical to SEQ ID NO: 1870
  source: /note="Description of Artificial Sequence: Synthetic polynucleotide"

SEQ ID NO: 4151 - DNA, 495 bp, Artificial Sequence; identical to SEQ ID NO: 1871
  source: /note="Description of Artificial Sequence: Synthetic polynucleotide"

SEQ ID NO: 4152 - DNA, 495 bp, Artificial Sequence; identical to SEQ ID NO: 1872
  source: /note="Description of Artificial Sequence: Synthetic polynucleotide"

SEQ ID NO: 4153 - DNA, 495 bp, Artificial Sequence; identical to SEQ ID NO: 1873
  source: /note="Description of Artificial Sequence: Synthetic polynucleotide"

SEQ ID NO: 4154 - DNA, 495 bp, Artificial Sequence; identical to SEQ ID NO: 1874
  source: /note="Description of Artificial Sequence: Synthetic polynucleotide"

SEQ ID NO: 4155 - DNA, 495 bp, Artificial Sequence; identical to SEQ ID NO: 1875
  source: /note="Description of Artificial Sequence: Synthetic polynucleotide"

SEQ ID NO: 4156 - DNA, 495 bp, Artificial Sequence; identical to SEQ ID NO: 1876
  source: /note="Description of Artificial Sequence: Synthetic polynucleotide"

SEQ ID NO: 4157 - DNA, 495 bp, Artificial Sequence; identical to SEQ ID NO: 1877
  source: /note="Description of Artificial Sequence: Synthetic polynucleotide"

SEQ ID NO: 4158 - DNA, 495 bp, Artificial Sequence; identical to SEQ ID NO: 1878
  source: /note="Description of Artificial Sequence: Synthetic polynucleotide"

SEQ ID NO: 4159 - DNA, 495 bp, Artificial Sequence; identical to SEQ ID NO: 1879
  source: /note="Description of Artificial Sequence: Synthetic polynucleotide"

SEQ ID NO: 4160 - DNA, 495 bp, Artificial Sequence; identical to SEQ ID NO: 1880
  source: /note="Description of Artificial Sequence: Synthetic polynucleotide"

SEQ ID NO: 4161 - DNA, 495 bp, Artificial Sequence; identical to SEQ ID NO: 1881
  source: /note="Description of Artificial Sequence: Synthetic polynucleotide"

SEQ ID NO: 4162 - DNA, 495 bp, Artificial Sequence; identical to SEQ ID NO: 1882
  source: /note="Description of Artificial Sequence: Synthetic polynucleotide"

SEQ ID NO: 4163 - DNA, 495 bp, Artificial Sequence; identical to SEQ ID NO: 1883
  source: /note="Description of Artificial Sequence: Synthetic polynucleotide"

SEQ ID NO: 4164 - DNA, 495 bp, Artificial Sequence; identical to SEQ ID NO: 1884
  source: /note="Description of Artificial Sequence: Synthetic polynucleotide"

SEQ ID NO: 4165 - DNA, 495 bp, Artificial Sequence; identical to SEQ ID NO: 1885
  source: /note="Description of Artificial Sequence: Synthetic polynucleotide"

SEQ ID NO: 4166 - DNA, 495 bp, Artificial Sequence; identical to SEQ ID NO: 1886
  source: /note="Description of Artificial Sequence: Synthetic polynucleotide"

SEQ ID NO: 4167 - DNA, 495 bp, Artificial Sequence; identical to SEQ ID NO: 1887
  source: /note="Description of Artificial Sequence: Synthetic polynucleotide"

SEQ ID NO: 4168 - DNA, 495 bp, Artificial Sequence; identical to SEQ ID NO: 1888
  source: /note="Description of Artificial Sequence: Synthetic polynucleotide"

SEQ ID NO: 4169 - DNA, 495 bp, Artificial Sequence; identical to SEQ ID NO: 1889
  source: /note="Description of Artificial Sequence: Synthetic polynucleotide"

SEQ ID NO: 4170 - DNA, 495 bp, Artificial Sequence; identical to SEQ ID NO: 1890
  source: /note="Description of Artificial Sequence: Synthetic polynucleotide"

SEQ ID NO: 4171 - DNA, 495 bp, Artificial Sequence; identical to SEQ ID NO: 1891
  source: /note="Description of Artificial Sequence: Synthetic polynucleotide"

SEQ ID NO: 4172 - DNA, 495 bp, Artificial Sequence; identical to SEQ ID NO: 1892
  source: /note="Description of Artificial Sequence: Synthetic polynucleotide"

SEQ ID NO: 4173 - DNA, 495 bp, Artificial Sequence; identical to SEQ ID NO: 1893
  source: /note="Description of Artificial Sequence: Synthetic polynucleotide"

SEQ ID NO: 4174 - DNA, 495 bp, Artificial Sequence; identical to SEQ ID NO: 1894
  source: /note="Description of Artificial Sequence: Synthetic polynucleotide"

SEQ ID NO: 4175 - DNA, 495 bp, Artificial Sequence; identical to SEQ ID NO: 1895
  source: /note="Description of Artificial Sequence: Synthetic polynucleotide"

SEQ ID NO: 4176 - DNA, 495 bp, Artificial Sequence; identical to SEQ ID NO: 1896
  source: /note="Description of Artificial Sequence: Synthetic polynucleotide"

SEQ ID NO: 4177 - DNA, 495 bp, Artificial Sequence; identical to SEQ ID NO: 1897
  source: /note="Description of Artificial Sequence: Synthetic polynucleotide"

SEQ ID NO: 4178 - DNA, 495 bp, Artificial Sequence; identical to SEQ ID NO: 1898
  source: /note="Description of Artificial Sequence: Synthetic polynucleotide"

SEQ ID NO: 4179 - DNA, 495 bp, Artificial Sequence; identical to SEQ ID NO: 1899
  source: /note="Description of Artificial Sequence: Synthetic polynucleotide"

SEQ ID NO: 4180 - DNA, 495 bp, Artificial Sequence; identical to SEQ ID NO: 1900
  source: /note="Description of Artificial Sequence: Synthetic polynucleotide"

SEQ ID NO: 4181 - DNA, 495 bp, Artificial Sequence; identical to SEQ ID NO: 1901
  source: /note="Description of Artificial Sequence: Synthetic polynucleotide"

SEQ ID NO: 4182 - DNA, 495 bp, Artificial Sequence; identical to SEQ ID NO: 1902
  source: /note="Description of Artificial Sequence: Synthetic polynucleotide"

SEQ ID NO: 4183 - DNA, 495 bp, Artificial Sequence; identical to SEQ ID NO: 1903
  source: /note="Description of Artificial Sequence: Synthetic polynucleotide"

SEQ ID NO: 4184 - DNA, 495 bp, Artificial Sequence; identical to SEQ ID NO: 1904
  source: /note="Description of Artificial Sequence: Synthetic polynucleotide"

SEQ ID NO: 4185 - DNA, 495 bp, Artificial Sequence; identical to SEQ ID NO: 1905
  source: /note="Description of Artificial Sequence: Synthetic polynucleotide"

SEQ ID NO: 4186 - DNA, 495 bp, Artificial Sequence; identical to SEQ ID NO: 1906
  source: /note="Description of Artificial Sequence: Synthetic polynucleotide"

SEQ ID NO: 4187 - DNA, 495 bp, Artificial Sequence; identical to SEQ ID NO: 1907
  source: /note="Description of Artificial Sequence: Synthetic polynucleotide"

SEQ ID NO: 4188 - DNA, 495 bp, Artificial Sequence; identical to SEQ ID NO: 1908
  source: /note="Description of Artificial Sequence: Synthetic polynucleotide"

SEQ ID NO: 4189 - DNA, 495 bp, Artificial Sequence; identical to SEQ ID NO: 1909
  source: /note="Description of Artificial Sequence: Synthetic polynucleotide"

SEQ ID NO: 4190 - DNA, 495 bp, Artificial Sequence; identical to SEQ ID NO: 1910
  source: /note="Description of Artificial Sequence: Synthetic polynucleotide"

SEQ ID NO: 4191 - DNA, 495 bp, Artificial Sequence; identical to SEQ ID NO: 1911
  source: /note="Description of Artificial Sequence: Synthetic polynucleotide"

SEQ ID NO: 4192 - DNA, 495 bp, Artificial Sequence; identical to SEQ ID NO: 1912
  source: /note="Description of Artificial Sequence: Synthetic polynucleotide"

SEQ ID NO: 4193 - DNA, 495 bp, Artificial Sequence; identical to SEQ ID NO: 1913
  source: /note="Description of Artificial Sequence: Synthetic polynucleotide"

SEQ ID NO: 4194 - DNA, 495 bp, Artificial Sequence; identical to SEQ ID NO: 1914
  source: /note="Description of Artificial Sequence: Synthetic polynucleotide"

SEQ ID NO: 4195 - DNA, 495 bp, Artificial Sequence; identical to SEQ ID NO: 1915
  source: /note="Description of Artificial Sequence: Synthetic polynucleotide"

SEQ ID NO: 4196 - DNA, 495 bp, Artificial Sequence; identical to SEQ ID NO: 1916
  source: /note="Description of Artificial Sequence: Synthetic polynucleotide"

SEQ ID NO: 4197 - DNA, 495 bp, Artificial Sequence; identical to SEQ ID NO: 1917
  source: /note="Description of Artificial Sequence: Synthetic polynucleotide"

SEQ ID NO: 4198 - DNA, 495 bp, Artificial Sequence; identical to SEQ ID NO: 1918
  source: /note="Description of Artificial Sequence: Synthetic polynucleotide"

SEQ ID NO: 4199 - DNA, 495 bp, Artificial Sequence; identical to SEQ ID NO: 1919
  source: /note="Description of Artificial Sequence: Synthetic polynucleotide"

SEQ ID NO: 4200 - DNA, 495 bp, Artificial Sequence; identical to SEQ ID NO: 1920
  source: /note="Description of Artificial Sequence: Synthetic polynucleotide"

SEQ ID NO: 4201 - DNA, 495 bp, Artificial Sequence; identical to SEQ ID NO: 1921
  source: /note="Description of Artificial Sequence: Synthetic polynucleotide"

SEQ ID NO: 4202 - DNA, 495 bp, Artificial Sequence; identical to SEQ ID NO: 1922
  source: /note="Description of Artificial Sequence: Synthetic polynucleotide"

SEQ ID NO: 4203 - DNA, 495 bp, Artificial Sequence; identical to SEQ ID NO: 1923
  source: /note="Description of Artificial Sequence: Synthetic polynucleotide"

SEQ ID NO: 4204 - DNA, 495 bp, Artificial Sequence; identical to SEQ ID NO: 1924
  source: /note="Description of Artificial Sequence: Synthetic polynucleotide"

SEQ ID NO: 4205 - DNA, 495 bp, Artificial Sequence; identical to SEQ ID NO: 1925
  source: /note="Description of Artificial Sequence: Synthetic polynucleotide"

SEQ ID NO: 4206 - DNA, 495 bp, Artificial Sequence; identical to SEQ ID NO: 1926
  source: /note="Description of Artificial Sequence: Synthetic polynucleotide"

SEQ ID NO: 4207 - DNA, 448 bp, Artificial Sequence; identical to SEQ ID NO: 1927
  source: /note="Description of Artificial Sequence: Synthetic polynucleotide"

SEQ ID NO: 4208 - DNA, 495 bp, Artificial Sequence; identical to SEQ ID NO: 1928
  source: /note="Description of Artificial Sequence: Synthetic polynucleotide"

SEQ ID NO: 4209 - DNA, 495 bp, Artificial Sequence; identical to SEQ ID NO: 1929
  source: /note="Description of Artificial Sequence: Synthetic polynucleotide"

SEQ ID NO: 4210 - DNA, 495 bp, Artificial Sequence; identical to SEQ ID NO: 1930
  source: /note="Description of Artificial Sequence: Synthetic polynucleotide"

SEQ ID NO: 4211 - DNA, 495 bp, Artificial Sequence; identical to SEQ ID NO: 1931
  source: /note="Description of Artificial Sequence: Synthetic polynucleotide"

SEQ ID NO: 4212 - DNA, 495 bp, Artificial Sequence; identical to SEQ ID NO: 1932
  source: /note="Description of Artificial Sequence: Synthetic polynucleotide"

SEQ ID NO: 4213 - DNA, 495 bp, Artificial Sequence; identical to SEQ ID NO: 1933
  source: /note="Description of Artificial Sequence: Synthetic polynucleotide"

SEQ ID NO: 4214 - DNA, 495 bp, Artificial Sequence; identical to SEQ ID NO: 1934
  source: /note="Description of Artificial Sequence: Synthetic polynucleotide"

SEQ ID NO: 4215 - DNA, 495 bp, Artificial Sequence; identical to SEQ ID NO: 1935
  source: /note="Description of Artificial Sequence: Synthetic polynucleotide"

SEQ ID NO: 4216 - DNA, 495 bp, Artificial Sequence; identical to SEQ ID NO: 1936
  source: /note="Description of Artificial Sequence: Synthetic polynucleotide"

SEQ ID NO: 4217 - DNA, 495 bp, Artificial Sequence; identical to SEQ ID NO: 1937
  source: /note="Description of Artificial Sequence: Synthetic polynucleotide"

SEQ ID NO: 4218 - DNA, 495 bp, Artificial Sequence; identical to SEQ ID NO: 1938
  source: /note="Description of Artificial Sequence: Synthetic polynucleotide"

SEQ ID NO: 4219 - DNA, 495 bp, Artificial Sequence; identical to SEQ ID NO: 1939
  source: /note="Description of Artificial Sequence: Synthetic polynucleotide"

SEQ ID NO: 4220 - DNA, 495 bp, Artificial Sequence; identical to SEQ ID NO: 1940
  source: /note="Description of Artificial Sequence: Synthetic polynucleotide"

SEQ ID NO: 4221 - DNA, 495 bp, Artificial Sequence; identical to SEQ ID NO: 1941
  source: /note="Description of Artificial Sequence: Synthetic polynucleotide"

SEQ ID NO: 4222 - DNA, 495 bp, Artificial Sequence; identical to SEQ ID NO: 1942
  source: /note="Description of Artificial Sequence: Synthetic polynucleotide"

SEQ ID NO: 4223 - DNA, 495 bp, Artificial Sequence; identical to SEQ ID NO: 1943
  source: /note="Description of Artificial Sequence: Synthetic polynucleotide"

SEQ ID NO: 4224 - DNA, 495 bp, Artificial Sequence; identical to SEQ ID NO: 1944
  source: /note="Description of Artificial Sequence: Synthetic polynucleotide"

SEQ ID NO: 4225 - DNA, 495 bp, Artificial Sequence; identical to SEQ ID NO: 1945
  source: /note="Description of Artificial Sequence: Synthetic polynucleotide"

SEQ ID NO: 4226 - DNA, 495 bp, Artificial Sequence; identical to SEQ ID NO: 1946
  source: /note="Description of Artificial Sequence: Synthetic polynucleotide"

SEQ ID NO: 4227 - DNA, 495 bp, Artificial Sequence; identical to SEQ ID NO: 1947
  source: /note="Description of Artificial Sequence: Synthetic polynucleotide"

SEQ ID NO: 4228 - DNA, 495 bp, Artificial Sequence; identical to SEQ ID NO: 1948
  source: /note="Description of Artificial Sequence: Synthetic polynucleotide"

SEQ ID NO: 4229 - DNA, 495 bp, Artificial Sequence; identical to SEQ ID NO: 1949
  source: /note="Description of Artificial Sequence: Synthetic polynucleotide"

SEQ ID NO: 4230 - DNA, 495 bp, Artificial Sequence; identical to SEQ ID NO: 1950
  source: /note="Description of Artificial Sequence: Synthetic polynucleotide"

SEQ ID NO: 4231 - DNA, 495 bp, Artificial Sequence; identical to SEQ ID NO: 1951
  source: /note="Description of Artificial Sequence: Synthetic polynucleotide"

SEQ ID NO: 4232 - DNA, 495 bp, Artificial Sequence; identical to SEQ ID NO: 1952
  source: /note="Description of Artificial Sequence: Synthetic polynucleotide"

SEQ ID NO: 4233 - DNA, 495 bp, Artificial Sequence; identical to SEQ ID NO: 1953
  source: /note="Description of Artificial Sequence: Synthetic polynucleotide"

SEQ ID NO: 4234 - DNA, 495 bp, Artificial Sequence; identical to SEQ ID NO: 1954
  source: /note="Description of Artificial Sequence: Synthetic polynucleotide"

SEQ ID NO: 4235 - DNA, 495 bp, Artificial Sequence; identical to SEQ ID NO: 1955
  source: /note="Description of Artificial Sequence: Synthetic polynucleotide"

SEQ ID NO: 4236 - DNA, 495 bp, Artificial Sequence; identical to SEQ ID NO: 1956
  source: /note="Description of Artificial Sequence: Synthetic polynucleotide"

SEQ ID NO: 4237 - DNA, 495 bp, Artificial Sequence; identical to SEQ ID NO: 1957
  source: /note="Description of Artificial Sequence: Synthetic polynucleotide"

SEQ ID NO: 4238 - DNA, 495 bp, Artificial Sequence; identical to SEQ ID NO: 1958
  source: /note="Description of Artificial Sequence: Synthetic polynucleotide"

SEQ ID NO: 4239 - DNA, 495 bp, Artificial Sequence; identical to SEQ ID NO: 1959
  source: /note="Description of Artificial Sequence: Synthetic polynucleotide"

SEQ ID NO: 4240 - DNA, 495 bp, Artificial Sequence; identical to SEQ ID NO: 1960
  source: /note="Description of Artificial Sequence: Synthetic polynucleotide"

SEQ ID NO: 4241 - DNA, 495 bp, Artificial Sequence; identical to SEQ ID NO: 1961
  source: /note="Description of Artificial Sequence: Synthetic polynucleotide"

SEQ ID NO: 4242 - DNA, 495 bp, Artificial Sequence; identical to SEQ ID NO: 1962
  source: /note="Description of Artificial Sequence: Synthetic polynucleotide"

SEQ ID NO: 4243 - DNA, 495 bp, Artificial Sequence; identical to SEQ ID NO: 1963
  source: /note="Description of Artificial Sequence: Synthetic polynucleotide"

SEQ ID NO: 4244 - DNA, 495 bp, Artificial Sequence; identical to SEQ ID NO: 1964
  source: /note="Description of Artificial Sequence: Synthetic polynucleotide"

SEQ ID NO: 4245 - DNA, 495 bp, Artificial Sequence; identical to SEQ ID NO: 1965
  source: /note="Description of Artificial Sequence: Synthetic polynucleotide"

SEQ ID NO: 4246 - DNA, 495 bp, Artificial Sequence; identical to SEQ ID NO: 1966
  source: /note="Description of Artificial Sequence: Synthetic polynucleotide"

SEQ ID NO: 4247 - DNA, 495 bp, Artificial Sequence; identical to SEQ ID NO: 1967
  source: /note="Description of Artificial Sequence: Synthetic polynucleotide"

SEQ ID NO: 4248 - DNA, 495 bp, Artificial Sequence; identical to SEQ ID NO: 1968
  source: /note="Description of Artificial Sequence: Synthetic polynucleotide"

SEQ ID NO: 4249 - DNA, 495 bp, Artificial Sequence; identical to SEQ ID NO: 1969
  source: /note="Description of Artificial Sequence: Synthetic polynucleotide"

SEQ ID NO: 4250 - DNA, 495 bp, Artificial Sequence; identical to SEQ ID NO: 1970
  source: /note="Description of Artificial Sequence: Synthetic polynucleotide"

SEQ ID NO: 4251 - DNA, 495 bp, Artificial Sequence; identical to SEQ ID NO: 1971
  source: /note="Description of Artificial Sequence: Synthetic polynucleotide"

SEQ ID NO: 4252 - DNA, 495 bp, Artificial Sequence; identical to SEQ ID NO: 1972
  source: /note="Description of Artificial Sequence: Synthetic polynucleotide"

SEQ ID NO: 4253 - DNA, 495 bp, Artificial Sequence; identical to SEQ ID NO: 1973
  source: /note="Description of Artificial Sequence: Synthetic polynucleotide"

SEQ ID NO: 4254 - DNA, 495 bp, Artificial Sequence; identical to SEQ ID NO: 1974
  source: /note="Description of Artificial Sequence: Synthetic polynucleotide"

SEQ ID NO: 4255 - DNA, 495 bp, Artificial Sequence; identical to SEQ ID NO: 1975
  source: /note="Description of Artificial Sequence: Synthetic polynucleotide"

SEQ ID NO: 4256 - DNA, 495 bp, Artificial Sequence; identical to SEQ ID NO: 1976
  source: /note="Description of Artificial Sequence: Synthetic polynucleotide"

SEQ ID NO: 4257 - DNA, 495 bp, Artificial Sequence; identical to SEQ ID NO: 1977
  source: /note="Description of Artificial Sequence: Synthetic polynucleotide"

SEQ ID NO: 4258 - DNA, 495 bp, Artificial Sequence; identical to SEQ ID NO: 1978
  source: /note="Description of Artificial Sequence: Synthetic polynucleotide"

SEQ ID NO: 4259 - DNA, 495 bp, Artificial Sequence; identical to SEQ ID NO: 1979
  source: /note="Description of Artificial Sequence: Synthetic polynucleotide"

SEQ ID NO: 4260 - DNA, 495 bp, Artificial Sequence; identical to SEQ ID NO: 1980
  source: /note="Description of Artificial Sequence: Synthetic polynucleotide"

SEQ ID NO: 4261 - DNA, 495 bp, Artificial Sequence; identical to SEQ ID NO: 1981
  source: /note="Description of Artificial Sequence: Synthetic polynucleotide"

SEQ ID NO: 4262 - DNA, 495 bp, Artificial Sequence; identical to SEQ ID NO: 1982
  source: /note="Description of Artificial Sequence: Synthetic polynucleotide"

SEQ ID NO: 4263 - DNA, 495 bp, Artificial Sequence; identical to SEQ ID NO: 1983
  source: /note="Description of Artificial Sequence: Synthetic polynucleotide"

SEQ ID NO: 4264 - DNA, 495 bp, Artificial Sequence; identical to SEQ ID NO: 1984
  source: /note="Description of Artificial Sequence: Synthetic polynucleotide"

SEQ ID NO: 4265 - DNA, 495 bp, Artificial Sequence; identical to SEQ ID NO: 1985
  source: /note="Description of Artificial Sequence: Synthetic polynucleotide"

SEQ ID NO: 4266 - DNA, 495 bp, Artificial Sequence; identical to SEQ ID NO: 1986
  source: /note="Description of Artificial Sequence: Synthetic polynucleotide"

SEQ ID NO: 4267 - DNA, 495 bp, Artificial Sequence; identical to SEQ ID NO: 1987
  source: /note="Description of Artificial Sequence: Synthetic polynucleotide"

SEQ ID NO: 4268 - DNA, 495 bp, Artificial Sequence; identical to SEQ ID NO: 1988
  source: /note="Description of Artificial Sequence: Synthetic polynucleotide"

SEQ ID NO: 4269 - DNA, 495 bp, Artificial Sequence; identical to SEQ ID NO: 1989
  source: /note="Description of Artificial Sequence: Synthetic polynucleotide"

SEQ ID NO: 4270 - DNA, 495 bp, Artificial Sequence; identical to SEQ ID NO: 1990
  source: /note="Description of Artificial Sequence: Synthetic polynucleotide"

SEQ ID NO: 4271 - DNA, 495 bp, Artificial Sequence; identical to SEQ ID NO: 1991
  source: /note="Description of Artificial Sequence: Synthetic polynucleotide"

SEQ ID NO: 4272 - DNA, 495 bp, Artificial Sequence; identical to SEQ ID NO: 1992
  source: /note="Description of Artificial Sequence: Synthetic polynucleotide"

SEQ ID NO: 4273 - DNA, 495 bp, Artificial Sequence; identical to SEQ ID NO: 1993
  source: /note="Description of Artificial Sequence: Synthetic polynucleotide"

SEQ ID NO: 4274 - DNA, 495 bp, Artificial Sequence; identical to SEQ ID NO: 1994
  source: /note="Description of Artificial Sequence: Synthetic polynucleotide"

SEQ ID NO: 4275 - DNA, 495 bp, Artificial Sequence; identical to SEQ ID NO: 1995
  source: /note="Description of Artificial Sequence: Synthetic polynucleotide"

SEQ ID NO: 4276 - DNA, 495 bp, Artificial Sequence; identical to SEQ ID NO: 1996
  source: /note="Description of Artificial Sequence: Synthetic polynucleotide"

SEQ ID NO: 4277 - DNA, 495 bp, Artificial Sequence; identical to SEQ ID NO: 1997
  source: /note="Description of Artificial Sequence: Synthetic polynucleotide"

SEQ ID NO: 4278 - DNA, 495 bp, Artificial Sequence; identical to SEQ ID NO: 1998
  source: /note="Description of Artificial Sequence: Synthetic polynucleotide"

SEQ ID NO: 4279 - DNA, 495 bp, Artificial Sequence; identical to SEQ ID NO: 1999
  source: /note="Description of Artificial Sequence: Synthetic polynucleotide"

SEQ ID NO: 4280 - DNA, 495 bp, Artificial Sequence; identical to SEQ ID NO: 2000
  source: /note="Description of Artificial Sequence: Synthetic polynucleotide"

SEQ ID NO: 4281 - DNA, 495 bp, Artificial Sequence; identical to SEQ ID NO: 2001
  source: /note="Description of Artificial Sequence: Synthetic polynucleotide"

SEQ ID NO: 4282 - DNA, 495 bp, Artificial Sequence; identical to SEQ ID NO: 2002
  source: /note="Description of Artificial Sequence: Synthetic polynucleotide"

SEQ ID NO: 4283 - DNA, 495 bp, Artificial Sequence; identical to SEQ ID NO: 2003
  source: /note="Description of Artificial Sequence: Synthetic polynucleotide"

SEQ ID NO: 4284 - DNA, 495 bp, Artificial Sequence; identical to SEQ ID NO: 2004
  source: /note="Description of Artificial Sequence: Synthetic polynucleotide"

SEQ ID NO: 4285 - DNA, 495 bp, Artificial Sequence; identical to SEQ ID NO: 2005
  source: /note="Description of Artificial Sequence: Synthetic polynucleotide"

SEQ ID NO: 4286 - DNA, 495 bp, Artificial Sequence; identical to SEQ ID NO: 2006
  source: /note="Description of Artificial Sequence: Synthetic polynucleotide"

SEQ ID NO: 4287 - DNA, 495 bp, Artificial Sequence; identical to SEQ ID NO: 2007
  source: /note="Description of Artificial Sequence: Synthetic polynucleotide"

SEQ ID NO: 4288 - DNA, 495 bp, Artificial Sequence; identical to SEQ ID NO: 2008
  source: /note="Description of Artificial Sequence: Synthetic polynucleotide"

SEQ ID NO: 4289 - DNA, 495 bp, Artificial Sequence; identical to SEQ ID NO: 2009
  source: /note="Description of Artificial Sequence: Synthetic polynucleotide"

SEQ ID NO: 4290 - DNA, 495 bp, Artificial Sequence; identical to SEQ ID NO: 2010
  source: /note="Description of Artificial Sequence: Synthetic polynucleotide"

SEQ ID NO: 4291 - DNA, 495 bp, Artificial Sequence; identical to SEQ ID NO: 2011
  source: /note="Description of Artificial Sequence: Synthetic polynucleotide"

SEQ ID NO: 4292 - DNA, 495 bp, Artificial Sequence; identical to SEQ ID NO: 2012
  source: /note="Description of Artificial Sequence: Synthetic polynucleotide"

SEQ ID NO: 4293 - DNA, 495 bp, Artificial Sequence; identical to SEQ ID NO: 2013
  source: /note="Description of Artificial Sequence: Synthetic polynucleotide"

SEQ ID NO: 4294 - DNA, 495 bp, Artificial Sequence; identical to SEQ ID NO: 2014
  source: /note="Description of Artificial Sequence: Synthetic polynucleotide"

SEQ ID NO: 4295 - DNA, 495 bp, Artificial Sequence; identical to SEQ ID NO: 2015
  source: /note="Description of Artificial Sequence: Synthetic polynucleotide"

SEQ ID NO: 4296 - DNA, 495 bp, Artificial Sequence; identical to SEQ ID NO: 2016
  source: /note="Description of Artificial Sequence: Synthetic polynucleotide"

SEQ ID NO: 4297 - DNA, 495 bp, Artificial Sequence; identical to SEQ ID NO: 2017
  source: /note="Description of Artificial Sequence: Synthetic polynucleotide"

SEQ ID NO: 4298 - DNA, 495 bp, Artificial Sequence; identical to SEQ ID NO: 2018
  source: /note="Description of Artificial Sequence: Synthetic polynucleotide"

SEQ ID NO: 4299 - DNA, 495 bp, Artificial Sequence; identical to SEQ ID NO: 2019
  source: /note="Description of Artificial Sequence: Synthetic polynucleotide"

SEQ ID NO: 4300 - DNA, 495 bp, Artificial Sequence; identical to SEQ ID NO: 2020
  source: /note="Description of Artificial Sequence: Synthetic polynucleotide"

SEQ ID NO: 4301 - DNA, 495 bp, Artificial Sequence; identical to SEQ ID NO: 2021
  source: /note="Description of Artificial Sequence: Synthetic polynucleotide"

SEQ ID NO: 4302 - DNA, 495 bp, Artificial Sequence; identical to SEQ ID NO: 2022
  source: /note="Description of Artificial Sequence: Synthetic polynucleotide"

SEQ ID NO: 4303 - DNA, 495 bp, Artificial Sequence; identical to SEQ ID NO: 2023
  source: /note="Description of Artificial Sequence: Synthetic polynucleotide"

SEQ ID NO: 4304 - DNA, 495 bp, Artificial Sequence; identical to SEQ ID NO: 2024
  source: /note="Description of Artificial Sequence: Synthetic polynucleotide"

SEQ ID NO: 4305 - DNA, 495 bp, Artificial Sequence; identical to SEQ ID NO: 2025
  source: /note="Description of Artificial Sequence: Synthetic polynucleotide"

SEQ ID NO: 4306 - DNA, 495 bp, Artificial Sequence; identical to SEQ ID NO: 2026
  source: /note="Description of Artificial Sequence: Synthetic polynucleotide"

SEQ ID NO: 4307 - DNA, 495 bp, Artificial Sequence; identical to SEQ ID NO: 2027
  source: /note="Description of Artificial Sequence: Synthetic polynucleotide"

SEQ ID NO: 4308 - DNA, 495 bp, Artificial Sequence; identical to SEQ ID NO: 2028
  source: /note="Description of Artificial Sequence: Synthetic polynucleotide"

SEQ ID NO: 4309 - DNA, 495 bp, Artificial Sequence; identical to SEQ ID NO: 2029
  source: /note="Description of Artificial Sequence: Synthetic polynucleotide"

SEQ ID NO: 4310 - DNA, 495 bp, Artificial Sequence; identical to SEQ ID NO: 2030
  source: /note="Description of Artificial Sequence: Synthetic polynucleotide"

SEQ ID NO: 4311 - DNA, 495 bp, Artificial Sequence; identical to SEQ ID NO: 2031
  source: /note="Description of Artificial Sequence: Synthetic polynucleotide"

SEQ ID NO: 4312 - DNA, 495 bp, Artificial Sequence; identical to SEQ ID NO: 2032
  source: /note="Description of Artificial Sequence: Synthetic polynucleotide"

SEQ ID NO: 4313 - DNA, 495 bp, Artificial Sequence; identical to SEQ ID NO: 2033
  source: /note="Description of Artificial Sequence: Synthetic polynucleotide"

SEQ ID NO: 4314 - DNA, 495 bp, Artificial Sequence; identical to SEQ ID NO: 2034
  source: /note="Description of Artificial Sequence: Synthetic polynucleotide"

SEQ ID NO: 4315 - DNA, 495 bp, Artificial Sequence; identical to SEQ ID NO: 2035
  source: /note="Description of Artificial Sequence: Synthetic polynucleotide"

SEQ ID NO: 4316 - DNA, 495 bp, Artificial Sequence; identical to SEQ ID NO: 2036
  source: /note="Description of Artificial Sequence: Synthetic polynucleotide"

SEQ ID NO: 4317 - DNA, 495 bp, Artificial Sequence; identical to SEQ ID NO: 2037
  source: /note="Description of Artificial Sequence: Synthetic polynucleotide"

SEQ ID NO: 4318 - DNA, 495 bp, Artificial Sequence; identical to SEQ ID NO: 2038
  source: /note="Description of Artificial Sequence: Synthetic polynucleotide"

SEQ ID NO: 4319 - DNA, 495 bp, Artificial Sequence; identical to SEQ ID NO: 2039
  source: /note="Description of Artificial Sequence: Synthetic polynucleotide"

SEQ ID NO: 4320 - DNA, 495 bp, Artificial Sequence; identical to SEQ ID NO: 2040
  source: /note="Description of Artificial Sequence: Synthetic polynucleotide"

SEQ ID NO: 4321 - DNA, 495 bp, Artificial Sequence; identical to SEQ ID NO: 2041
  source: /note="Description of Artificial Sequence: Synthetic polynucleotide"

SEQ ID NO: 4322 - DNA, 495 bp, Artificial Sequence; identical to SEQ ID NO: 2042
  source: /note="Description of Artificial Sequence: Synthetic polynucleotide"

SEQ ID NO: 4323 - DNA, 495 bp, Artificial Sequence; identical to SEQ ID NO: 2043
  source: /note="Description of Artificial Sequence: Synthetic polynucleotide"

SEQ ID NO: 4324 - DNA, 495 bp, Artificial Sequence; identical to SEQ ID NO: 2044
  source: /note="Description of Artificial Sequence: Synthetic polynucleotide"

SEQ ID NO: 4325 - DNA, 495 bp, Artificial Sequence; identical to SEQ ID NO: 2045
  source: /note="Description of Artificial Sequence: Synthetic polynucleotide"

SEQ ID NO: 4326 - DNA, 495 bp, Artificial Sequence; identical to SEQ ID NO: 2046
  source: /note="Description of Artificial Sequence: Synthetic polynucleotide"

SEQ ID NO: 4327 - DNA, 495 bp, Artificial Sequence; identical to SEQ ID NO: 2047
  source: /note="Description of Artificial Sequence: Synthetic polynucleotide"

SEQ ID NO: 4328 - DNA, 495 bp, Artificial Sequence; identical to SEQ ID NO: 2048
  source: /note="Description of Artificial Sequence: Synthetic polynucleotide"

SEQ ID NO: 4329 - DNA, 495 bp, Artificial Sequence; identical to SEQ ID NO: 2049
  source: /note="Description of Artificial Sequence: Synthetic polynucleotide"

SEQ ID NO: 4330 - DNA, 495 bp, Artificial Sequence; identical to SEQ ID NO: 2050
  source: /note="Description of Artificial Sequence: Synthetic polynucleotide"

SEQ ID NO: 4331 - DNA, 448 bp, Artificial Sequence; identical to SEQ ID NO: 2051
  source: /note="Description of Artificial Sequence: Synthetic polynucleotide"

SEQ ID NO: 4332 - DNA, 495 bp, Artificial Sequence; identical to SEQ ID NO: 2052
  source: /note="Description of Artificial Sequence: Synthetic polynucleotide"

SEQ ID NO: 4333 - DNA, 495 bp, Artificial Sequence; identical to SEQ ID NO: 2053
  source: /note="Description of Artificial Sequence: Synthetic polynucleotide"

SEQ ID NO: 4334 - DNA, 495 bp, Artificial Sequence; identical to SEQ ID NO: 2054
  source: /note="Description of Artificial Sequence: Synthetic polynucleotide"

SEQ ID NO: 4335 - DNA, 495 bp, Artificial Sequence; identical to SEQ ID NO: 2055
  source: /note="Description of Artificial Sequence: Synthetic polynucleotide"

SEQ ID NO: 4336 - DNA, 495 bp, Artificial Sequence; identical to SEQ ID NO: 2056
  source: /note="Description of Artificial Sequence: Synthetic polynucleotide"

SEQ ID NO: 4337 - DNA, 495 bp, Artificial Sequence; identical to SEQ ID NO: 2057
  source: /note="Description of Artificial Sequence: Synthetic polynucleotide"

SEQ ID NO: 4338 - DNA, 495 bp, Artificial Sequence; identical to SEQ ID NO: 2058
  source: /note="Description of Artificial Sequence: Synthetic polynucleotide"

SEQ ID NO: 4339 - DNA, 495 bp, Artificial Sequence; identical to SEQ ID NO: 2059
  source: /note="Description of Artificial Sequence: Synthetic polynucleotide"

SEQ ID NO: 4340 - DNA, 495 bp, Artificial Sequence; identical to SEQ ID NO: 2060
  source: /note="Description of Artificial Sequence: Synthetic polynucleotide"

SEQ ID NO: 4341 - DNA, 495 bp, Artificial Sequence; identical to SEQ ID NO: 2061
  source: /note="Description of Artificial Sequence: Synthetic polynucleotide"

SEQ ID NO: 4342 - DNA, 495 bp, Artificial Sequence; identical to SEQ ID NO: 2062
  source: /note="Description of Artificial Sequence: Synthetic polynucleotide"

SEQ ID NO: 4343 - DNA, 495 bp, Artificial Sequence; identical to SEQ ID NO: 2063
  source: /note="Description of Artificial Sequence: Synthetic polynucleotide"

SEQ ID NO: 4344 - DNA, 495 bp, Artificial Sequence; identical to SEQ ID NO: 2064
  source: /note="Description of Artificial Sequence: Synthetic polynucleotide"

SEQ ID NO: 4345 - DNA, 495 bp, Artificial Sequence; identical to SEQ ID NO: 2065
  source: /note="Description of Artificial Sequence: Synthetic polynucleotide"

SEQ ID NO: 4346 - DNA, 495 bp, Artificial Sequence; identical to SEQ ID NO: 2066
  source: /note="Description of Artificial Sequence: Synthetic polynucleotide"

SEQ ID NO: 4347 - DNA, 495 bp, Artificial Sequence; identical to SEQ ID NO: 2067
  source: /note="Description of Artificial Sequence: Synthetic polynucleotide"

SEQ ID NO: 4348 - DNA, 495 bp, Artificial Sequence; identical to SEQ ID NO: 2068
  source: /note="Description of Artificial Sequence: Synthetic polynucleotide"

SEQ ID NO: 4349 - DNA, 495 bp, Artificial Sequence; identical to SEQ ID NO: 2069
  source: /note="Description of Artificial Sequence: Synthetic polynucleotide"

SEQ ID NO: 4350 - DNA, 495 bp, Artificial Sequence; identical to SEQ ID NO: 2070
  source: /note="Description of Artificial Sequence: Synthetic polynucleotide"

SEQ ID NO: 4351 - DNA, 495 bp, Artificial Sequence; identical to SEQ ID NO: 2071
  source: /note="Description of Artificial Sequence: Synthetic polynucleotide"

SEQ ID NO: 4352 - DNA, 495 bp, Artificial Sequence; identical to SEQ ID NO: 2072
  source: /note="Description of Artificial Sequence: Synthetic polynucleotide"

SEQ ID NO: 4353 - DNA, 495 bp, Artificial Sequence; identical to SEQ ID NO: 2073
  source: /note="Description of Artificial Sequence: Synthetic polynucleotide"

SEQ ID NO: 4354 - DNA, 495 bp, Artificial Sequence; identical to SEQ ID NO: 2074
  source: /note="Description of Artificial Sequence: Synthetic polynucleotide"

SEQ ID NO: 4355 - DNA, 495 bp, Artificial Sequence; identical to SEQ ID NO: 2075
  source: /note="Description of Artificial Sequence: Synthetic polynucleotide"

SEQ ID NO: 4356 - DNA, 495 bp, Artificial Sequence; identical to SEQ ID NO: 2076
  source: /note="Description of Artificial Sequence: Synthetic polynucleotide"

SEQ ID NO: 4357 - DNA, 495 bp, Artificial Sequence; identical to SEQ ID NO: 2077
  source: /note="Description of Artificial Sequence: Synthetic polynucleotide"

SEQ ID NO: 4358 - DNA, 495 bp, Artificial Sequence; identical to SEQ ID NO: 2078
  source: /note="Description of Artificial Sequence: Synthetic polynucleotide"

SEQ ID NO: 4359 - DNA, 495 bp, Artificial Sequence; identical to SEQ ID NO: 2079
  source: /note="Description of Artificial Sequence: Synthetic polynucleotide"

SEQ ID NO: 4360 - DNA, 495 bp, Artificial Sequence; identical to SEQ ID NO: 2080
  source: /note="Description of Artificial Sequence: Synthetic polynucleotide"

SEQ ID NO: 4361 - DNA, 495 bp, Artificial Sequence; identical to SEQ ID NO: 2081
  source: /note="Description of Artificial Sequence: Synthetic polynucleotide"

SEQ ID NO: 4362 - DNA, 495 bp, Artificial Sequence; identical to SEQ ID NO: 2082
  source: /note="Description of Artificial Sequence: Synthetic polynucleotide"

SEQ ID NO: 4363 - DNA, 495 bp, Artificial Sequence; identical to SEQ ID NO: 2083
  source: /note="Description of Artificial Sequence: Synthetic polynucleotide"

SEQ ID NO: 4364 - DNA, 495 bp, Artificial Sequence; identical to SEQ ID NO: 2084
  source: /note="Description of Artificial Sequence: Synthetic polynucleotide"

SEQ ID NO: 4365 - DNA, 495 bp, Artificial Sequence; identical to SEQ ID NO: 2085
  source: /note="Description of Artificial Sequence: Synthetic polynucleotide"

SEQ ID NO: 4366 - DNA, 495 bp, Artificial Sequence; identical to SEQ ID NO: 2086
  source: /note="Description of Artificial Sequence: Synthetic polynucleotide"

SEQ ID NO: 4367 - DNA, 495 bp, Artificial Sequence; identical to SEQ ID NO: 2087
  source: /note="Description of Artificial Sequence: Synthetic polynucleotide"

SEQ ID NO: 4368 - DNA, 495 bp, Artificial Sequence; identical to SEQ ID NO: 2088
  source: /note="Description of Artificial Sequence: Synthetic polynucleotide"

SEQ ID NO: 4369 - DNA, 495 bp, Artificial Sequence; identical to SEQ ID NO: 2089
  source: /note="Description of Artificial Sequence: Synthetic polynucleotide"

SEQ ID NO: 4370 - DNA, 495 bp, Artificial Sequence; identical to SEQ ID NO: 2090
  source: /note="Description of Artificial Sequence: Synthetic polynucleotide"

SEQ ID NO: 4371 - DNA, 495 bp, Artificial Sequence; identical to SEQ ID NO: 2091
  source: /note="Description of Artificial Sequence: Synthetic polynucleotide"

SEQ ID NO: 4372 - DNA, 495 bp, Artificial Sequence; identical to SEQ ID NO: 2092
  source: /note="Description of Artificial Sequence: Synthetic polynucleotide"

SEQ ID NO: 4373 - DNA, 495 bp, Artificial Sequence; identical to SEQ ID NO: 2093
  source: /note="Description of Artificial Sequence: Synthetic polynucleotide"

SEQ ID NO: 4374 - DNA, 495 bp, Artificial Sequence; identical to SEQ ID NO: 2094
  source: /note="Description of Artificial Sequence: Synthetic polynucleotide"

SEQ ID NO: 4375 - DNA, 495 bp, Artificial Sequence; identical to SEQ ID NO: 2095
  source: /note="Description of Artificial Sequence: Synthetic polynucleotide"

SEQ ID NO: 4376 - DNA, 495 bp, Artificial Sequence; identical to SEQ ID NO: 2096
  source: /note="Description of Artificial Sequence: Synthetic polynucleotide"

SEQ ID NO: 4377 - DNA, 495 bp, Artificial Sequence; identical to SEQ ID NO: 2097
  source: /note="Description of Artificial Sequence: Synthetic polynucleotide"

SEQ ID NO: 4378 - DNA, 495 bp, Artificial Sequence; identical to SEQ ID NO: 2098
  source: /note="Description of Artificial Sequence: Synthetic polynucleotide"

SEQ ID NO: 4379 - DNA, 495 bp, Artificial Sequence; identical to SEQ ID NO: 2099
  source: /note="Description of Artificial Sequence: Synthetic polynucleotide"

SEQ ID NO: 4380 - DNA, 495 bp, Artificial Sequence; identical to SEQ ID NO: 2100
  source: /note="Description of Artificial Sequence: Synthetic polynucleotide"

SEQ ID NO: 4381 - DNA, 495 bp, Artificial Sequence; identical to SEQ ID NO: 2101
  source: /note="Description of Artificial Sequence: Synthetic polynucleotide"

SEQ ID NO: 4382 - DNA, 495 bp, Artificial Sequence; identical to SEQ ID NO: 2102
  source: /note="Description of Artificial Sequence: Synthetic polynucleotide"

SEQ ID NO: 4383 - DNA, 495 bp, Artificial Sequence; identical to SEQ ID NO: 2103
  source: /note="Description of Artificial Sequence: Synthetic polynucleotide"

SEQ ID NO: 4384 - DNA, 495 bp, Artificial Sequence; identical to SEQ ID NO: 2104
  source: /note="Description of Artificial Sequence: Synthetic polynucleotide"

SEQ ID NO: 4385 - DNA, 495 bp, Artificial Sequence; identical to SEQ ID NO: 2105
  source: /note="Description of Artificial Sequence: Synthetic polynucleotide"

SEQ ID NO: 4386 - DNA, 495 bp, Artificial Sequence; identical to SEQ ID NO: 2106
  source: /note="Description of Artificial Sequence: Synthetic polynucleotide"

SEQ ID NO: 4387 - DNA, 495 bp, Artificial Sequence; identical to SEQ ID NO: 2107
  source: /note="Description of Artificial Sequence: Synthetic polynucleotide"

SEQ ID NO: 4388 - DNA, 495 bp, Artificial Sequence; identical to SEQ ID NO: 2108
  source: /note="Description of Artificial Sequence: Synthetic polynucleotide"

SEQ ID NO: 4389 - DNA, 495 bp, Artificial Sequence; identical to SEQ ID NO: 2109
  source: /note="Description of Artificial Sequence: Synthetic polynucleotide"

SEQ ID NO: 4390 - DNA, 495 bp, Artificial Sequence; identical to SEQ ID NO: 2110
  source: /note="Description of Artificial Sequence: Synthetic polynucleotide"

SEQ ID NO: 4391 - DNA, 495 bp, Artificial Sequence; identical to SEQ ID NO: 2111
  source: /note="Description of Artificial Sequence: Synthetic polynucleotide"

SEQ ID NO: 4392 - DNA, 495 bp, Artificial Sequence; identical to SEQ ID NO: 2112
  source: /note="Description of Artificial Sequence: Synthetic polynucleotide"

SEQ ID NO: 4393 - DNA, 495 bp, Artificial Sequence; identical to SEQ ID NO: 2113
  source: /note="Description of Artificial Sequence: Synthetic polynucleotide"

SEQ ID NO: 4394 - DNA, 495 bp, Artificial Sequence; identical to SEQ ID NO: 2114
  source: /note="Description of Artificial Sequence: Synthetic polynucleotide"

SEQ ID NO: 4395 - DNA, 495 bp, Artificial Sequence; identical to SEQ ID NO: 2115
  source: /note="Description of Artificial Sequence: Synthetic polynucleotide"

SEQ ID NO: 4396 - DNA, 495 bp, Artificial Sequence; identical to SEQ ID NO: 2116
  source: /note="Description of Artificial Sequence: Synthetic polynucleotide"

SEQ ID NO: 4397 - DNA, 495 bp, Artificial Sequence; identical to SEQ ID NO: 2117
  source: /note="Description of Artificial Sequence: Synthetic polynucleotide"

SEQ ID NO: 4398 - DNA, 495 bp, Artificial Sequence; identical to SEQ ID NO: 2118
  source: /note="Description of Artificial Sequence: Synthetic polynucleotide"

SEQ ID NO: 4399 - DNA, 495 bp, Artificial Sequence; identical to SEQ ID NO: 2119
  source: /note="Description of Artificial Sequence: Synthetic polynucleotide"

SEQ ID NO: 4400 - DNA, 495 bp, Artificial Sequence; identical to SEQ ID NO: 2120
  source: /note="Description of Artificial Sequence: Synthetic polynucleotide"

SEQ ID NO: 4401 - DNA, 495 bp, Artificial Sequence; identical to SEQ ID NO: 2121
  source: /note="Description of Artificial Sequence: Synthetic polynucleotide"

SEQ ID NO: 4402 - DNA, 495 bp, Artificial Sequence; identical to SEQ ID NO: 2122
  source: /note="Description of Artificial Sequence: Synthetic polynucleotide"

SEQ ID NO: 4403 - DNA, 495 bp, Artificial Sequence; identical to SEQ ID NO: 2123
  source: /note="Description of Artificial Sequence: Synthetic polynucleotide"

SEQ ID NO: 4404 - DNA, 495 bp, Artificial Sequence; identical to SEQ ID NO: 2124
  source: /note="Description of Artificial Sequence: Synthetic polynucleotide"

SEQ ID NO: 4405 - DNA, 495 bp, Artificial Sequence; identical to SEQ ID NO: 2125
  source: /note="Description of Artificial Sequence: Synthetic polynucleotide"

SEQ ID NO: 4406 - DNA, 495 bp, Artificial Sequence; identical to SEQ ID NO: 2126
  source: /note="Description of Artificial Sequence: Synthetic polynucleotide"

SEQ ID NO: 4407 - DNA, 495 bp, Artificial Sequence; identical to SEQ ID NO: 2127
  source: /note="Description of Artificial Sequence: Synthetic polynucleotide"

SEQ ID NO: 4408 - DNA, 495 bp, Artificial Sequence; identical to SEQ ID NO: 2128
  source: /note="Description of Artificial Sequence: Synthetic polynucleotide"

SEQ ID NO: 4409 - DNA, 495 bp, Artificial Sequence; identical to SEQ ID NO: 2129
  source: /note="Description of Artificial Sequence: Synthetic polynucleotide"

SEQ ID NO: 4410 - DNA, 495 bp, Artificial Sequence; identical to SEQ ID NO: 2130
  source: /note="Description of Artificial Sequence: Synthetic polynucleotide"

SEQ ID NO: 4411 - DNA, 495 bp, Artificial Sequence; identical to SEQ ID NO: 2131
  source: /note="Description of Artificial Sequence: Synthetic polynucleotide"

SEQ ID NO: 4412 - DNA, 495 bp, Artificial Sequence; identical to SEQ ID NO: 2132
  source: /note="Description of Artificial Sequence: Synthetic polynucleotide"

SEQ ID NO: 4413 - DNA, 495 bp, Artificial Sequence; identical to SEQ ID NO: 2133
  source: /note="Description of Artificial Sequence: Synthetic polynucleotide"

SEQ ID NO: 4414 - DNA, 495 bp, Artificial Sequence; identical to SEQ ID NO: 2134
  source: /note="Description of Artificial Sequence: Synthetic polynucleotide"

SEQ ID NO: 4415 - DNA, 495 bp, Artificial Sequence; identical to SEQ ID NO: 2135
  source: /note="Description of Artificial Sequence: Synthetic polynucleotide"

SEQ ID NO: 4416 - DNA, 495 bp, Artificial Sequence; identical to SEQ ID NO: 2136
  source: /note="Description of Artificial Sequence: Synthetic polynucleotide"

SEQ ID NO: 4417 - DNA, 495 bp, Artificial Sequence; identical to SEQ ID NO: 2137
  source: /note="Description of Artificial Sequence: Synthetic polynucleotide"

SEQ ID NO: 4418 - DNA, 495 bp, Artificial Sequence; identical to SEQ ID NO: 2138
  source: /note="Description of Artificial Sequence: Synthetic polynucleotide"

SEQ ID NO: 4419 - DNA, 495 bp, Artificial Sequence; identical to SEQ ID NO: 2139
  source: /note="Description of Artificial Sequence: Synthetic polynucleotide"

SEQ ID NO: 4420 - DNA, 495 bp, Artificial Sequence; identical to SEQ ID NO: 2140
  source: /note="Description of Artificial Sequence: Synthetic polynucleotide"

SEQ ID NO: 4421 - DNA, 495 bp, Artificial Sequence; identical to SEQ ID NO: 2141
  source: /note="Description of Artificial Sequence: Synthetic polynucleotide"

SEQ ID NO: 4422 - DNA, 495 bp, Artificial Sequence; identical to SEQ ID NO: 2142
  source: /note="Description of Artificial Sequence: Synthetic polynucleotide"

SEQ ID NO: 4423 - DNA, 495 bp, Artificial Sequence; identical to SEQ ID NO: 2143
  source: /note="Description of Artificial Sequence: Synthetic polynucleotide"

SEQ ID NO: 4424 - DNA, 495 bp, Artificial Sequence; identical to SEQ ID NO: 2144
  source: /note="Description of Artificial Sequence: Synthetic polynucleotide"

SEQ ID NO: 4425 - DNA, 495 bp, Artificial Sequence; identical to SEQ ID NO: 2145
  source: /note="Description of Artificial Sequence: Synthetic polynucleotide"

SEQ ID NO: 4426 - DNA, 495 bp, Artificial Sequence; identical to SEQ ID NO: 2146
  source: /note="Description of Artificial Sequence: Synthetic polynucleotide"

SEQ ID NO: 4427 - DNA, 495 bp, Artificial Sequence; identical to SEQ ID NO: 2147
  source: /note="Description of Artificial Sequence: Synthetic polynucleotide"

SEQ ID NO: 4428 - DNA, 495 bp, Artificial Sequence; identical to SEQ ID NO: 2148
  source: /note="Description of Artificial Sequence: Synthetic polynucleotide"

SEQ ID NO: 4429 - DNA, 495 bp, Artificial Sequence; identical to SEQ ID NO: 2149
  source: /note="Description of Artificial Sequence: Synthetic polynucleotide"

SEQ ID NO: 4430 - DNA, 495 bp, Artificial Sequence; identical to SEQ ID NO: 2150
  source: /note="Description of Artificial Sequence: Synthetic polynucleotide"

SEQ ID NO: 4431 - DNA, 495 bp, Artificial Sequence; identical to SEQ ID NO: 2151
  source: /note="Description of Artificial Sequence: Synthetic polynucleotide"

SEQ ID NO: 4432 - DNA, 495 bp, Artificial Sequence; identical to SEQ ID NO: 2152
  source: /note="Description of Artificial Sequence: Synthetic polynucleotide"

SEQ ID NO: 4433 - DNA, 495 bp, Artificial Sequence; identical to SEQ ID NO: 2153
  source: /note="Description of Artificial Sequence: Synthetic polynucleotide"

SEQ ID NO: 4434 - DNA, 495 bp, Artificial Sequence; identical to SEQ ID NO: 2154
  source: /note="Description of Artificial Sequence: Synthetic polynucleotide"

SEQ ID NO: 4435 - DNA, 495 bp, Artificial Sequence; identical to SEQ ID NO: 2155
  source: /note="Description of Artificial Sequence: Synthetic polynucleotide"

SEQ ID NO: 4436 - DNA, 495 bp, Artificial Sequence; identical to SEQ ID NO: 2156
  source: /note="Description of Artificial Sequence: Synthetic polynucleotide"

SEQ ID NO: 4437 - DNA, 495 bp, Artificial Sequence; identical to SEQ ID NO: 2157
  source: /note="Description of Artificial Sequence: Synthetic polynucleotide"

SEQ ID NO: 4438 - DNA, 495 bp, Artificial Sequence; identical to SEQ ID NO: 2158
  source: /note="Description of Artificial Sequence: Synthetic polynucleotide"

SEQ ID NO: 4439 - DNA, 495 bp, Artificial Sequence; identical to SEQ ID NO: 2159
  source: /note="Description of Artificial Sequence: Synthetic polynucleotide"

SEQ ID NO: 4440 - DNA, 495 bp, Artificial Sequence; identical to SEQ ID NO: 2160
  source: /note="Description of Artificial Sequence: Synthetic polynucleotide"

SEQ ID NO: 4441 - DNA, 495 bp, Artificial Sequence; identical to SEQ ID NO: 2161
  source: /note="Description of Artificial Sequence: Synthetic polynucleotide"

SEQ ID NO: 4442 - DNA, 495 bp, Artificial Sequence; identical to SEQ ID NO: 2162
  source: /note="Description of Artificial Sequence: Synthetic polynucleotide"

SEQ ID NO: 4443 - DNA, 495 bp, Artificial Sequence; identical to SEQ ID NO: 2163
  source: /note="Description of Artificial Sequence: Synthetic polynucleotide"

SEQ ID NO: 4444 - DNA, 495 bp, Artificial Sequence; identical to SEQ ID NO: 2164
  source: /note="Description of Artificial Sequence: Synthetic polynucleotide"

SEQ ID NO: 4445 - DNA, 495 bp, Artificial Sequence; identical to SEQ ID NO: 2165
  source: /note="Description of Artificial Sequence: Synthetic polynucleotide"

SEQ ID NO: 4446 - DNA, 495 bp, Artificial Sequence; identical to SEQ ID NO: 2166
  source: /note="Description of Artificial Sequence: Synthetic polynucleotide"

SEQ ID NO: 4447 - DNA, 495 bp, Artificial Sequence; identical to SEQ ID NO: 2167
  source: /note="Description of Artificial Sequence: Synthetic polynucleotide"

SEQ ID NO: 4448 - DNA, 495 bp, Artificial Sequence; identical to SEQ ID NO: 2168
  source: /note="Description of Artificial Sequence: Synthetic polynucleotide"

SEQ ID NO: 4449 - DNA, 495 bp, Artificial Sequence; identical to SEQ ID NO: 2169
  source: /note="Description of Artificial Sequence: Synthetic polynucleotide"

SEQ ID NO: 4450 - DNA, 495 bp, Artificial Sequence; identical to SEQ ID NO: 2170
  source: /note="Description of Artificial Sequence: Synthetic polynucleotide"

SEQ ID NO: 4451 - DNA, 495 bp, Artificial Sequence; identical to SEQ ID NO: 2171
  source: /note="Description of Artificial Sequence: Synthetic polynucleotide"

SEQ ID NO: 4452 - DNA, 495 bp, Artificial Sequence; identical to SEQ ID NO: 2172
  source: /note="Description of Artificial Sequence: Synthetic polynucleotide"

SEQ ID NO: 4453 - DNA, 495 bp, Artificial Sequence; identical to SEQ ID NO: 2173
  source: /note="Description of Artificial Sequence: Synthetic polynucleotide"

SEQ ID NO: 4454 - DNA, 495 bp, Artificial Sequence; identical to SEQ ID NO: 2174
  source: /note="Description of Artificial Sequence: Synthetic polynucleotide"

SEQ ID NO: 4455 - DNA, 448 bp, Artificial Sequence; identical to SEQ ID NO: 2175
  source: /note="Description of Artificial Sequence: Synthetic polynucleotide"

SEQ ID NO: 4456 - DNA, 495 bp, Artificial Sequence; identical to SEQ ID NO: 2176
  source: /note="Description of Artificial Sequence: Synthetic polynucleotide"

SEQ ID NO: 4457 - DNA, 495 bp, Artificial Sequence; identical to SEQ ID NO: 2177
  source: /note="Description of Artificial Sequence: Synthetic polynucleotide"

SEQ ID NO: 4458 - DNA, 495 bp, Artificial Sequence; identical to SEQ ID NO: 2178
  source: /note="Description of Artificial Sequence: Synthetic polynucleotide"

SEQ ID NO: 4459 - DNA, 495 bp, Artificial Sequence; identical to SEQ ID NO: 2179
  source: /note="Description of Artificial Sequence: Synthetic polynucleotide"

SEQ ID NO: 4460 - DNA, 495 bp, Artificial Sequence; identical to SEQ ID NO: 2180
  source: /note="Description of Artificial Sequence: Synthetic polynucleotide"

SEQ ID NO: 4461 - DNA, 495 bp, Artificial Sequence; identical to SEQ ID NO: 2181
  source: /note="Description of Artificial Sequence: Synthetic polynucleotide"

SEQ ID NO: 4462 - DNA, 495 bp, Artificial Sequence; identical to SEQ ID NO: 2182
  source: /note="Description of Artificial Sequence: Synthetic polynucleotide"

SEQ ID NO: 4463 - DNA, 495 bp, Artificial Sequence; identical to SEQ ID NO: 2183
  source: /note="Description of Artificial Sequence: Synthetic polynucleotide"

SEQ ID NO: 4464 - DNA, 495 bp, Artificial Sequence; identical to SEQ ID NO: 2184
  source: /note="Description of Artificial Sequence: Synthetic polynucleotide"

SEQ ID NO: 4465 - DNA, 495 bp, Artificial Sequence; identical to SEQ ID NO: 2185
  source: /note="Description of Artificial Sequence: Synthetic polynucleotide"

SEQ ID NO: 4466 - DNA, 495 bp, Artificial Sequence; identical to SEQ ID NO: 2186
  source: /note="Description of Artificial Sequence: Synthetic polynucleotide"

SEQ ID NO: 4467 - DNA, 495 bp, Artificial Sequence; identical to SEQ ID NO: 2187
  source: /note="Description of Artificial Sequence: Synthetic polynucleotide"

SEQ ID NO: 4468 - DNA, 495 bp, Artificial Sequence; identical to SEQ ID NO: 2188
  source: /note="Description of Artificial Sequence: Synthetic polynucleotide"

SEQ ID NO: 4469 - DNA, 495 bp, Artificial Sequence; identical to SEQ ID NO: 2189
  source: /note="Description of Artificial Sequence: Synthetic polynucleotide"

SEQ ID NO: 4470 - DNA, 495 bp, Artificial Sequence; identical to SEQ ID NO: 2190
  source: /note="Description of Artificial Sequence: Synthetic polynucleotide"

SEQ ID NO: 4471 - DNA, 495 bp, Artificial Sequence; identical to SEQ ID NO: 2191
  source: /note="Description of Artificial Sequence: Synthetic polynucleotide"

SEQ ID NO: 4472 - DNA, 495 bp, Artificial Sequence; identical to SEQ ID NO: 2192
  source: /note="Description of Artificial Sequence: Synthetic polynucleotide"

SEQ ID NO: 4473 - DNA, 495 bp, Artificial Sequence; identical to SEQ ID NO: 2193
  source: /note="Description of Artificial Sequence: Synthetic polynucleotide"

SEQ ID NO: 4474 - DNA, 495 bp, Artificial Sequence; identical to SEQ ID NO: 2194
  source: /note="Description of Artificial Sequence: Synthetic polynucleotide"

SEQ ID NO: 4475 - DNA, 495 bp, Artificial Sequence; identical to SEQ ID NO: 2195
  source: /note="Description of Artificial Sequence: Synthetic polynucleotide"

SEQ ID NO: 4476 - DNA, 495 bp, Artificial Sequence; identical to SEQ ID NO: 2196
  source: /note="Description of Artificial Sequence: Synthetic polynucleotide"

SEQ ID NO: 4477 - DNA, 495 bp, Artificial Sequence; identical to SEQ ID NO: 2197
  source: /note="Description of Artificial Sequence: Synthetic polynucleotide"

SEQ ID NO: 4478 - DNA, 495 bp, Artificial Sequence; identical to SEQ ID NO: 2198
  source: /note="Description of Artificial Sequence: Synthetic polynucleotide"

SEQ ID NO: 4479 - DNA, 495 bp, Artificial Sequence; identical to SEQ ID NO: 2199
  source: /note="Description of Artificial Sequence: Synthetic polynucleotide"

SEQ ID NO: 4480 - DNA, 495 bp, Artificial Sequence; identical to SEQ ID NO: 2200
  source: /note="Description of Artificial Sequence: Synthetic polynucleotide"

SEQ ID NO: 4481 - DNA, 495 bp, Artificial Sequence; identical to SEQ ID NO: 2201
  source: /note="Description of Artificial Sequence: Synthetic polynucleotide"

SEQ ID NO: 4482 - DNA, 495 bp, Artificial Sequence; identical to SEQ ID NO: 2202
  source: /note="Description of Artificial Sequence: Synthetic polynucleotide"

SEQ ID NO: 4483 - DNA, 495 bp, Artificial Sequence; identical to SEQ ID NO: 2203
  source: /note="Description of Artificial Sequence: Synthetic polynucleotide"

SEQ ID NO: 4484 - DNA, 495 bp, Artificial Sequence; identical to SEQ ID NO: 2204
  source: /note="Description of Artificial Sequence: Synthetic polynucleotide"

SEQ ID NO: 4485 - DNA, 495 bp, Artificial Sequence; identical to SEQ ID NO: 2205
  source: /note="Description of Artificial Sequence: Synthetic polynucleotide"

SEQ ID NO: 4486 - DNA, 495 bp, Artificial Sequence; identical to SEQ ID NO: 2206
  source: /note="Description of Artificial Sequence: Synthetic polynucleotide"

SEQ ID NO: 4487 - DNA, 495 bp, Artificial Sequence; identical to SEQ ID NO: 2207
  source: /note="Description of Artificial Sequence: Synthetic polynucleotide"

SEQ ID NO: 4488 - DNA, 495 bp, Artificial Sequence; identical to SEQ ID NO: 2208
  source: /note="Description of Artificial Sequence: Synthetic polynucleotide"

SEQ ID NO: 4489 - DNA, 495 bp, Artificial Sequence; identical to SEQ ID NO: 2209
  source: /note="Description of Artificial Sequence: Synthetic polynucleotide"

SEQ ID NO: 4490 - DNA, 495 bp, Artificial Sequence; identical to SEQ ID NO: 2210
  source: /note="Description of Artificial Sequence: Synthetic polynucleotide"

SEQ ID NO: 4491 - DNA, 495 bp, Artificial Sequence; identical to SEQ ID NO: 2211
  source: /note="Description of Artificial Sequence: Synthetic polynucleotide"

SEQ ID NO: 4492 - DNA, 495 bp, Artificial Sequence; identical to SEQ ID NO: 2212
  source: /note="Description of Artificial Sequence: Synthetic polynucleotide"

SEQ ID NO: 4493 - DNA, 495 bp, Artificial Sequence; identical to SEQ ID NO: 2213
  source: /note="Description of Artificial Sequence: Synthetic polynucleotide"

SEQ ID NO: 4494 - DNA, 495 bp, Artificial Sequence; identical to SEQ ID NO: 2214
  source: /note="Description of Artificial Sequence: Synthetic polynucleotide"

SEQ ID NO: 4495 - DNA, 495 bp, Artificial Sequence; identical to SEQ ID NO: 2215
  source: /note="Description of Artificial Sequence: Synthetic polynucleotide"

SEQ ID NO: 4496 - DNA, 495 bp, Artificial Sequence; identical to SEQ ID NO: 2216
  source: /note="Description of Artificial Sequence: Synthetic polynucleotide"

SEQ ID NO: 4497 - DNA, 495 bp, Artificial Sequence; identical to SEQ ID NO: 2217
  source: /note="Description of Artificial Sequence: Synthetic polynucleotide"

SEQ ID NO: 4498 - DNA, 495 bp, Artificial Sequence; identical to SEQ ID NO: 2218
  source: /note="Description of Artificial Sequence: Synthetic polynucleotide"

SEQ ID NO: 4499 - DNA, 495 bp, Artificial Sequence; identical to SEQ ID NO: 2219
  source: /note="Description of Artificial Sequence: Synthetic polynucleotide"

SEQ ID NO: 4500 - DNA, 495 bp, Artificial Sequence; identical to SEQ ID NO: 2220
  source: /note="Description of Artificial Sequence: Synthetic polynucleotide"

SEQ ID NO: 4501 - DNA, 495 bp, Artificial Sequence; identical to SEQ ID NO: 2221
  source: /note="Description of Artificial Sequence: Synthetic polynucleotide"

SEQ ID NO: 4502 - DNA, 495 bp, Artificial Sequence; identical to SEQ ID NO: 2222
  source: /note="Description of Artificial Sequence: Synthetic polynucleotide"

SEQ ID NO: 4503 - DNA, 495 bp, Artificial Sequence; identical to SEQ ID NO: 2223
  source: /note="Description of Artificial Sequence: Synthetic polynucleotide"

SEQ ID NO: 4504 - DNA, 495 bp, Artificial Sequence; identical to SEQ ID NO: 2224
  source: /note="Description of Artificial Sequence: Synthetic polynucleotide"

SEQ ID NO: 4505 - DNA, 495 bp, Artificial Sequence; identical to SEQ ID NO: 2225
  source: /note="Description of Artificial Sequence: Synthetic polynucleotide"

SEQ ID NO: 4506 - DNA, 495 bp, Artificial Sequence; identical to SEQ ID NO: 2226
  source: /note="Description of Artificial Sequence: Synthetic polynucleotide"

SEQ ID NO: 4507 - DNA, 495 bp, Artificial Sequence; identical to SEQ ID NO: 2227
  source: /note="Description of Artificial Sequence: Synthetic polynucleotide"

SEQ ID NO: 4508 - DNA, 495 bp, Artificial Sequence; identical to SEQ ID NO: 2228
  source: /note="Description of Artificial Sequence: Synthetic polynucleotide"

SEQ ID NO: 4509 - DNA, 495 bp, Artificial Sequence; identical to SEQ ID NO: 2229
  source: /note="Description of Artificial Sequence: Synthetic polynucleotide"

SEQ ID NO: 4510 - DNA, 495 bp, Artificial Sequence; identical to SEQ ID NO: 2230
  source: /note="Description of Artificial Sequence: Synthetic polynucleotide"

SEQ ID NO: 4511 - DNA, 495 bp, Artificial Sequence; identical to SEQ ID NO: 2231
  source: /note="Description of Artificial Sequence: Synthetic polynucleotide"

SEQ ID NO: 4512 - DNA, 495 bp, Artificial Sequence; identical to SEQ ID NO: 2232
  source: /note="Description of Artificial Sequence: Synthetic polynucleotide"

SEQ ID NO: 4513 - DNA, 495 bp, Artificial Sequence; identical to SEQ ID NO: 2233
  source: /note="Description of Artificial Sequence: Synthetic polynucleotide"

SEQ ID NO: 4514 - DNA, 495 bp, Artificial Sequence; identical to SEQ ID NO: 2234
  source: /note="Description of Artificial Sequence: Synthetic polynucleotide"

SEQ ID NO: 4515 - DNA, 495 bp, Artificial Sequence; identical to SEQ ID NO: 2235
  source: /note="Description of Artificial Sequence: Synthetic polynucleotide"

SEQ ID NO: 4516 - DNA, 495 bp, Artificial Sequence; identical to SEQ ID NO: 2236
  source: /note="Description of Artificial Sequence: Synthetic polynucleotide"

SEQ ID NO: 4517 - DNA, 495 bp, Artificial Sequence; identical to SEQ ID NO: 2237
  source: /note="Description of Artificial Sequence: Synthetic polynucleotide"

SEQ ID NO: 4518 - DNA, 495 bp, Artificial Sequence; identical to SEQ ID NO: 2238
  source: /note="Description of Artificial Sequence: Synthetic polynucleotide"

SEQ ID NO: 4519 - DNA, 495 bp, Artificial Sequence; identical to SEQ ID NO: 2239
  source: /note="Description of Artificial Sequence: Synthetic polynucleotide"

SEQ ID NO: 4520 - DNA, 495 bp, Artificial Sequence; identical to SEQ ID NO: 2240
  source: /note="Description of Artificial Sequence: Synthetic polynucleotide"

SEQ ID NO: 4521 - DNA, 495 bp, Artificial Sequence; identical to SEQ ID NO: 2241
  source: /note="Description of Artificial Sequence: Synthetic polynucleotide"

SEQ ID NO: 4522 - DNA, 495 bp, Artificial Sequence; identical to SEQ ID NO: 2242
  source: /note="Description of Artificial Sequence: Synthetic polynucleotide"

SEQ ID NO: 4523 - DNA, 495 bp, Artificial Sequence; identical to SEQ ID NO: 2243
  source: /note="Description of Artificial Sequence: Synthetic polynucleotide"

SEQ ID NO: 4524 - DNA, 495 bp, Artificial Sequence; identical to SEQ ID NO: 2244
  source: /note="Description of Artificial Sequence: Synthetic polynucleotide"

SEQ ID NO: 4525 - DNA, 495 bp, Artificial Sequence; identical to SEQ ID NO: 2245
  source: /note="Description of Artificial Sequence: Synthetic polynucleotide"

SEQ ID NO: 4526 - DNA, 495 bp, Artificial Sequence; identical to SEQ ID NO: 2246
  source: /note="Description of Artificial Sequence: Synthetic polynucleotide"

SEQ ID NO: 4527 - DNA, 495 bp, Artificial Sequence; identical to SEQ ID NO: 2247
  source: /note="Description of Artificial Sequence: Synthetic polynucleotide"

SEQ ID NO: 4528 - DNA, 495 bp, Artificial Sequence; identical to SEQ ID NO: 2248
  source: /note="Description of Artificial Sequence: Synthetic polynucleotide"

SEQ ID NO: 4529 - DNA, 495 bp, Artificial Sequence; identical to SEQ ID NO: 2249
  source: /note="Description of Artificial Sequence: Synthetic polynucleotide"

SEQ ID NO: 4530 - DNA, 495 bp, Artificial Sequence; identical to SEQ ID NO: 2250
  source: /note="Description of Artificial Sequence: Synthetic polynucleotide"

SEQ ID NO: 4531 - DNA, 495 bp, Artificial Sequence; identical to SEQ ID NO: 2251
  source: /note="Description of Artificial Sequence: Synthetic polynucleotide"

SEQ ID NO: 4532 - DNA, 495 bp, Artificial Sequence; identical to SEQ ID NO: 2252
  source: /note="Description of Artificial Sequence: Synthetic polynucleotide"

SEQ ID NO: 4533 - DNA, 495 bp, Artificial Sequence; identical to SEQ ID NO: 2253
  source: /note="Description of Artificial Sequence: Synthetic polynucleotide"

SEQ ID NO: 4534 - DNA, 495 bp, Artificial Sequence; identical to SEQ ID NO: 2254
  source: /note="Description of Artificial Sequence: Synthetic polynucleotide"

SEQ ID NO: 4535 - DNA, 495 bp, Artificial Sequence; identical to SEQ ID NO: 2255
  source: /note="Description of Artificial Sequence: Synthetic polynucleotide"

SEQ ID NO: 4536 - DNA, 495 bp, Artificial Sequence; identical to SEQ ID NO: 2256
  source: /note="Description of Artificial Sequence: Synthetic polynucleotide"

SEQ ID NO: 4537 - DNA, 495 bp, Artificial Sequence; identical to SEQ ID NO: 2257
  source: /note="Description of Artificial Sequence: Synthetic polynucleotide"

SEQ ID NO: 4538 - DNA, 495 bp, Artificial Sequence; identical to SEQ ID NO: 2258
  source: /note="Description of Artificial Sequence: Synthetic polynucleotide"

SEQ ID NO: 4539 - DNA, 495 bp, Artificial Sequence; identical to SEQ ID NO: 2259
  source: /note="Description of Artificial Sequence: Synthetic polynucleotide"

SEQ ID NO: 4540 - DNA, 495 bp, Artificial Sequence; identical to SEQ ID NO: 2260
  source: /note="Description of Artificial Sequence: Synthetic polynucleotide"

SEQ ID NO: 4541 - DNA, 495 bp, Artificial Sequence; identical to SEQ ID NO: 2261
  source: /note="Description of Artificial Sequence: Synthetic polynucleotide"

SEQ ID NO: 4542 - DNA, 495 bp, Artificial Sequence; identical to SEQ ID NO: 2262
  source: /note="Description of Artificial Sequence: Synthetic polynucleotide"

SEQ ID NO: 4543 - DNA, 495 bp, Artificial Sequence; identical to SEQ ID NO: 2263
  source: /note="Description of Artificial Sequence: Synthetic polynucleotide"

SEQ ID NO: 4544 - DNA, 495 bp, Artificial Sequence; identical to SEQ ID NO: 2264
  source: /note="Description of Artificial Sequence: Synthetic polynucleotide"

SEQ ID NO: 4545 - DNA, 495 bp, Artificial Sequence; identical to SEQ ID NO: 2265
  source: /note="Description of Artificial Sequence: Synthetic polynucleotide"

SEQ ID NO: 4546 - DNA, 495 bp, Artificial Sequence; identical to SEQ ID NO: 2266
  source: /note="Description of Artificial Sequence: Synthetic polynucleotide"

SEQ ID NO: 4547 - DNA, 495 bp, Artificial Sequence; identical to SEQ ID NO: 2267
  source: /note="Description of Artificial Sequence: Synthetic polynucleotide"

SEQ ID NO: 4548 - DNA, 495 bp, Artificial Sequence; identical to SEQ ID NO: 2268
  source: /note="Description of Artificial Sequence: Synthetic polynucleotide"

SEQ ID NO: 4549 - DNA, 495 bp, Artificial Sequence; identical to SEQ ID NO: 2269
  source: /note="Description of Artificial Sequence: Synthetic polynucleotide"

SEQ ID NO: 4550 - DNA, 495 bp, Artificial Sequence; identical to SEQ ID NO: 2270
  source: /note="Description of Artificial Sequence: Synthetic polynucleotide"

SEQ ID NO: 4551 - DNA, 495 bp, Artificial Sequence; identical to SEQ ID NO: 2271
  source: /note="Description of Artificial Sequence: Synthetic polynucleotide"

SEQ ID NO: 4552 - DNA, 495 bp, Artificial Sequence; identical to SEQ ID NO: 2272
  source: /note="Description of Artificial Sequence: Synthetic polynucleotide"

SEQ ID NO: 4553 - DNA, 495 bp, Artificial Sequence; identical to SEQ ID NO: 2273
  source: /note="Description of Artificial Sequence: Synthetic polynucleotide"

SEQ ID NO: 4554 - DNA, 495 bp, Artificial Sequence; identical to SEQ ID NO: 2274
  source: /note="Description of Artificial Sequence: Synthetic polynucleotide"

SEQ ID NO: 4555 - DNA, 495 bp, Artificial Sequence; identical to SEQ ID NO: 2275
  source: /note="Description of Artificial Sequence: Synthetic polynucleotide"

SEQ ID NO: 4556 - DNA, 495 bp, Artificial Sequence; identical to SEQ ID NO: 2276
  source: /note="Description of Artificial Sequence: Synthetic polynucleotide"

SEQ ID NO: 4557 - DNA, 495 bp, Artificial Sequence; identical to SEQ ID NO: 2277
  source: /note="Description of Artificial Sequence: Synthetic polynucleotide"

SEQ ID NO: 4558 - DNA, 495 bp, Artificial Sequence; identical to SEQ ID NO: 2278
  source: /note="Description of Artificial Sequence: Synthetic polynucleotide"

SEQ ID NO: 4559 - DNA, 495 bp, Artificial Sequence; identical to SEQ ID NO: 2279
  source: /note="Description of Artificial Sequence: Synthetic polynucleotide"

SEQ ID NO: 4560 - DNA, 495 bp, Artificial Sequence; identical to SEQ ID NO: 2280
  source: /note="Description of Artificial Sequence: Synthetic polynucleotide"

SEQ ID NO: 4561 - DNA, 495 bp, Artificial Sequence; identical to SEQ ID NO: 2281
  source: /note="Description of Artificial Sequence: Synthetic polynucleotide"

SEQ ID NO: 4562 - DNA, 495 bp, Artificial Sequence; identical to SEQ ID NO: 2282
  source: /note="Description of Artificial Sequence: Synthetic polynucleotide"

SEQ ID NO: 4563 - DNA, 495 bp, Artificial Sequence; identical to SEQ ID NO: 2283
  source: /note="Description of Artificial Sequence: Synthetic polynucleotide"

SEQ ID NO: 4564 - DNA, 495 bp, Artificial Sequence; identical to SEQ ID NO: 2284
  source: /note="Description of Artificial Sequence: Synthetic polynucleotide"

SEQ ID NO: 4565 - DNA, 495 bp, Artificial Sequence; identical to SEQ ID NO: 2285
  source: /note="Description of Artificial Sequence: Synthetic polynucleotide"

SEQ ID NO: 4566 - DNA, 495 bp, Artificial Sequence; identical to SEQ ID NO: 2286
  source: /note="Description of Artificial Sequence: Synthetic polynucleotide"

SEQ ID NO: 4567 - DNA, 495 bp, Artificial Sequence; identical to SEQ ID NO: 2287
  source: /note="Description of Artificial Sequence: Synthetic polynucleotide"

SEQ ID NO: 4568 - DNA, 495 bp, Artificial Sequence; identical to SEQ ID NO: 2288
  source: /note="Description of Artificial Sequence: Synthetic polynucleotide"

SEQ ID NO: 4569 - DNA, 495 bp, Artificial Sequence; identical to SEQ ID NO: 2289
  source: /note="Description of Artificial Sequence: Synthetic polynucleotide"

SEQ ID NO: 4570 - DNA, 495 bp, Artificial Sequence; identical to SEQ ID NO: 2290
  source: /note="Description of Artificial Sequence: Synthetic polynucleotide"

SEQ ID NO: 4571 - DNA, 495 bp, Artificial Sequence; identical to SEQ ID NO: 2291
  source: /note="Description of Artificial Sequence: Synthetic polynucleotide"

SEQ ID NO: 4572 - DNA, 495 bp, Artificial Sequence; identical to SEQ ID NO: 2292
  source: /note="Description of Artificial Sequence: Synthetic polynucleotide"

SEQ ID NO: 4573 - DNA, 495 bp, Artificial Sequence; identical to SEQ ID NO: 2293
  source: /note="Description of Artificial Sequence: Synthetic polynucleotide"

SEQ ID NO: 4574 - DNA, 495 bp, Artificial Sequence; identical to SEQ ID NO: 2294
  source: /note="Description of Artificial Sequence: Synthetic polynucleotide"

SEQ ID NO: 4575 - DNA, 495 bp, Artificial Sequence; identical to SEQ ID NO: 2295
  source: /note="Description of Artificial Sequence: Synthetic polynucleotide"

SEQ ID NO: 4576 - DNA, 495 bp, Artificial Sequence; identical to SEQ ID NO: 2296
  source: /note="Description of Artificial Sequence: Synthetic polynucleotide"

SEQ ID NO: 4577 - DNA, 495 bp, Artificial Sequence; identical to SEQ ID NO: 2297
  source: /note="Description of Artificial Sequence: Synthetic polynucleotide"

SEQ ID NO: 4578 - DNA, 495 bp, Artificial Sequence; identical to SEQ ID NO: 2298
  source: /note="Description of Artificial Sequence: Synthetic polynucleotide"

SEQ ID NO: 4579 - DNA, 448 bp, Artificial Sequence; identical to SEQ ID NO: 2299
  source: /note="Description of Artificial Sequence: Synthetic polynucleotide"

SEQ ID NO: 4580 - DNA, 495 bp, Artificial Sequence; identical to SEQ ID NO: 2300
  source: /note="Description of Artificial Sequence: Synthetic polynucleotide"

SEQ ID NO: 4581 - DNA, 495 bp, Artificial Sequence; identical to SEQ ID NO: 2301
  source: /note="Description of Artificial Sequence: Synthetic polynucleotide"

SEQ ID NO: 4582 - DNA, 495 bp, Artificial Sequence; identical to SEQ ID NO: 2302
  source: /note="Description of Artificial Sequence: Synthetic polynucleotide"

SEQ ID NO: 4583 - DNA, 495 bp, Artificial Sequence; identical to SEQ ID NO: 2303
  source: /note="Description of Artificial Sequence: Synthetic polynucleotide"

SEQ ID NO: 4584 - DNA, 495 bp, Artificial Sequence; identical to SEQ ID NO: 2304
  source: /note="Description of Artificial Sequence: Synthetic polynucleotide"

SEQ ID NO: 4585 - DNA, 495 bp, Artificial Sequence; identical to SEQ ID NO: 2305
  source: /note="Description of Artificial Sequence: Synthetic polynucleotide"

SEQ ID NO: 4586 - DNA, 495 bp, Artificial Sequence; identical to SEQ ID NO: 2306
  source: /note="Description of Artificial Sequence: Synthetic polynucleotide"

SEQ ID NO: 4587 - DNA, 495 bp, Artificial Sequence; identical to SEQ ID NO: 2307
  source: /note="Description of Artificial Sequence: Synthetic polynucleotide"

SEQ ID NO: 4588 - DNA, 495 bp, Artificial Sequence; identical to SEQ ID NO: 2308
  source: /note="Description of Artificial Sequence: Synthetic polynucleotide"

SEQ ID NO: 4589 - DNA, 495 bp, Artificial Sequence; identical to SEQ ID NO: 2309
  source: /note="Description of Artificial Sequence: Synthetic polynucleotide"

SEQ ID NO: 4590 - DNA, 495 bp, Artificial Sequence; identical to SEQ ID NO: 2310
  source: /note="Description of Artificial Sequence: Synthetic polynucleotide"

SEQ ID NO: 4591 - DNA, 495 bp, Artificial Sequence; identical to SEQ ID NO: 2311
  source: /note="Description of Artificial Sequence: Synthetic polynucleotide"

SEQ ID NO: 4592 - DNA, 495 bp, Artificial Sequence; identical to SEQ ID NO: 2312
  source: /note="Description of Artificial Sequence: Synthetic polynucleotide"

SEQ ID NO: 4593 - DNA, 495 bp, Artificial Sequence; identical to SEQ ID NO: 2313
  source: /note="Description of Artificial Sequence: Synthetic polynucleotide"

SEQ ID NO: 4594 - DNA, 495 bp, Artificial Sequence; identical to SEQ ID NO: 2314
  source: /note="Description of Artificial Sequence: Synthetic polynucleotide"

SEQ ID NO: 4595 - DNA, 495 bp, Artificial Sequence; identical to SEQ ID NO: 2315
  source: /note="Description of Artificial Sequence: Synthetic polynucleotide"

SEQ ID NO: 4596 - DNA, 495 bp, Artificial Sequence; identical to SEQ ID NO: 2316
  source: /note="Description of Artificial Sequence: Synthetic polynucleotide"

SEQ ID NO: 4597 - DNA, 495 bp, Artificial Sequence; identical to SEQ ID NO: 2317
  source: /note="Description of Artificial Sequence: Synthetic polynucleotide"

SEQ ID NO: 4598 - DNA, 495 bp, Artificial Sequence; identical to SEQ ID NO: 2318
  source: /note="Description of Artificial Sequence: Synthetic polynucleotide"

SEQ ID NO: 4599 - DNA, 495 bp, Artificial Sequence; identical to SEQ ID NO: 2319
  source: /note="Description of Artificial Sequence: Synthetic polynucleotide"

SEQ ID NO: 4600 - DNA, 495 bp, Artificial Sequence; identical to SEQ ID NO: 2320
  source: /note="Description of Artificial Sequence: Synthetic polynucleotide"

SEQ ID NO: 4601 - DNA, 495 bp, Artificial Sequence; identical to SEQ ID NO: 2321
  source: /note="Description of Artificial Sequence: Synthetic polynucleotide"

SEQ ID NO: 4602 - DNA, 495 bp, Artificial Sequence; identical to SEQ ID NO: 2322
  source: /note="Description of Artificial Sequence: Synthetic polynucleotide"

SEQ ID NO: 4603 - DNA, 495 bp, Artificial Sequence; identical to SEQ ID NO: 2323
  source: /note="Description of Artificial Sequence: Synthetic polynucleotide"

SEQ ID NO: 4604 - DNA, 495 bp, Artificial Sequence; identical to SEQ ID NO: 2324
  source: /note="Description of Artificial Sequence: Synthetic polynucleotide"

SEQ ID NO: 4605 - DNA, 495 bp, Artificial Sequence; identical to SEQ ID NO: 2325
  source: /note="Description of Artificial Sequence: Synthetic polynucleotide"

SEQ ID NO: 4606 - DNA, 495 bp, Artificial Sequence; identical to SEQ ID NO: 2326
  source: /note="Description of Artificial Sequence: Synthetic polynucleotide"

SEQ ID NO: 4607 - DNA, 495 bp, Artificial Sequence; identical to SEQ ID NO: 2327
  source: /note="Description of Artificial Sequence: Synthetic polynucleotide"

SEQ ID NO: 4608 - DNA, 495 bp, Artificial Sequence; identical to SEQ ID NO: 2328
  source: /note="Description of Artificial Sequence: Synthetic polynucleotide"

SEQ ID NO: 4609 - DNA, 495 bp, Artificial Sequence; identical to SEQ ID NO: 2329
  source: /note="Description of Artificial Sequence: Synthetic polynucleotide"

SEQ ID NO: 4610 - DNA, 495 bp, Artificial Sequence; identical to SEQ ID NO: 2330
  source: /note="Description of Artificial Sequence: Synthetic polynucleotide"

SEQ ID NO: 4611 - DNA, 495 bp, Artificial Sequence; identical to SEQ ID NO: 2331
  source: /note="Description of Artificial Sequence: Synthetic polynucleotide"

SEQ ID NO: 4612 - DNA, 495 bp, Artificial Sequence; identical to SEQ ID NO: 2332
  source: /note="Description of Artificial Sequence: Synthetic polynucleotide"

SEQ ID NO: 4613 - DNA, 495 bp, Artificial Sequence; identical to SEQ ID NO: 2333
  source: /note="Description of Artificial Sequence: Synthetic polynucleotide"

SEQ ID NO: 4614 - DNA, 495 bp, Artificial Sequence; identical to SEQ ID NO: 2334
  source: /note="Description of Artificial Sequence: Synthetic polynucleotide"

SEQ ID NO: 4615 - DNA, 495 bp, Artificial Sequence; identical to SEQ ID NO: 2335
  source: /note="Description of Artificial Sequence: Synthetic polynucleotide"

SEQ ID NO: 4616 - DNA, 495 bp, Artificial Sequence; identical to SEQ ID NO: 2336
  source: /note="Description of Artificial Sequence: Synthetic polynucleotide"

SEQ ID NO: 4617 - DNA, 495 bp, Artificial Sequence; identical to SEQ ID NO: 2337
  source: /note="Description of Artificial Sequence: Synthetic polynucleotide"

SEQ ID NO: 4618 - DNA, 495 bp, Artificial Sequence; identical to SEQ ID NO: 2338
  source: /note="Description of Artificial Sequence: Synthetic polynucleotide"

SEQ ID NO: 4619 - DNA, 495 bp, Artificial Sequence; identical to SEQ ID NO: 2339
  source: /note="Description of Artificial Sequence: Synthetic polynucleotide"

SEQ ID NO: 4620 - DNA, 495 bp, Artificial Sequence; identical to SEQ ID NO: 2340
  source: /note="Description of Artificial Sequence: Synthetic polynucleotide"

SEQ ID NO: 4621 - DNA, 495 bp, Artificial Sequence; identical to SEQ ID NO: 2341
  source: /note="Description of Artificial Sequence: Synthetic polynucleotide"

SEQ ID NO: 4622 - DNA, 495 bp, Artificial Sequence; identical to SEQ ID NO: 2342
  source: /note="Description of Artificial Sequence: Synthetic polynucleotide"

SEQ ID NO: 4623 - DNA, 495 bp, Artificial Sequence; identical to SEQ ID NO: 2343
  source: /note="Description of Artificial Sequence: Synthetic polynucleotide"

SEQ ID NO: 4624 - DNA, 495 bp, Artificial Sequence; identical to SEQ ID NO: 2344
  source: /note="Description of Artificial Sequence: Synthetic polynucleotide"

SEQ ID NO: 4625 - DNA, 495 bp, Artificial Sequence; identical to SEQ ID NO: 2345
  source: /note="Description of Artificial Sequence: Synthetic polynucleotide"

SEQ ID NO: 4626 - DNA, 495 bp, Artificial Sequence; identical to SEQ ID NO: 2346
  source: /note="Description of Artificial Sequence: Synthetic polynucleotide"

SEQ ID NO: 4627 - DNA, 495 bp, Artificial Sequence; identical to SEQ ID NO: 2347
  source: /note="Description of Artificial Sequence: Synthetic polynucleotide"

SEQ ID NO: 4628 - DNA, 495 bp, Artificial Sequence; identical to SEQ ID NO: 2348
  source: /note="Description of Artificial Sequence: Synthetic polynucleotide"

SEQ ID NO: 4629 - DNA, 495 bp, Artificial Sequence; identical to SEQ ID NO: 2349
  source: /note="Description of Artificial Sequence: Synthetic polynucleotide"

SEQ ID NO: 4630 - DNA, 495 bp, Artificial Sequence; identical to SEQ ID NO: 2350
  source: /note="Description of Artificial Sequence: Synthetic polynucleotide"

SEQ ID NO: 4631 - DNA, 495 bp, Artificial Sequence; identical to SEQ ID NO: 2351
  source: /note="Description of Artificial Sequence: Synthetic polynucleotide"

SEQ ID NO: 4632 - DNA, 495 bp, Artificial Sequence; identical to SEQ ID NO: 2352
  source: /note="Description of Artificial Sequence: Synthetic polynucleotide"

SEQ ID NO: 4633 - DNA, 495 bp, Artificial Sequence; identical to SEQ ID NO: 2353
  source: /note="Description of Artificial Sequence: Synthetic polynucleotide"

SEQ ID NO: 4634 - DNA, 495 bp, Artificial Sequence; identical to SEQ ID NO: 2354
  source: /note="Description of Artificial Sequence: Synthetic polynucleotide"

SEQ ID NO: 4635 - DNA, 495 bp, Artificial Sequence; identical to SEQ ID NO: 2355
  source: /note="Description of Artificial Sequence: Synthetic polynucleotide"

SEQ ID NO: 4636 - DNA, 495 bp, Artificial Sequence; identical to SEQ ID NO: 2356
  source: /note="Description of Artificial Sequence: Synthetic polynucleotide"

SEQ ID NO: 4637 - DNA, 495 bp, Artificial Sequence; identical to SEQ ID NO: 2357
  source: /note="Description of Artificial Sequence: Synthetic polynucleotide"

SEQ ID NO: 4638 - DNA, 495 bp, Artificial Sequence; identical to SEQ ID NO: 2358
  source: /note="Description of Artificial Sequence: Synthetic polynucleotide"

SEQ ID NO: 4639 - DNA, 495 bp, Artificial Sequence; identical to SEQ ID NO: 2359
  source: /note="Description of Artificial Sequence: Synthetic polynucleotide"

SEQ ID NO: 4640 - DNA, 495 bp, Artificial Sequence; identical to SEQ ID NO: 2360
  source: /note="Description of Artificial Sequence: Synthetic polynucleotide"

SEQ ID NO: 4641 - DNA, 495 bp, Artificial Sequence; identical to SEQ ID NO: 2361
  source: /note="Description of Artificial Sequence: Synthetic polynucleotide"

SEQ ID NO: 4642 - DNA, 495 bp, Artificial Sequence; identical to SEQ ID NO: 2362
  source: /note="Description of Artificial Sequence: Synthetic polynucleotide"

SEQ ID NO: 4643 - DNA, 495 bp, Artificial Sequence; identical to SEQ ID NO: 2363
  source: /note="Description of Artificial Sequence: Synthetic polynucleotide"

SEQ ID NO: 4644 - DNA, 495 bp, Artificial Sequence; identical to SEQ ID NO: 2364
  source: /note="Description of Artificial Sequence: Synthetic polynucleotide"

SEQ ID NO: 4645 - DNA, 495 bp, Artificial Sequence; identical to SEQ ID NO: 2365
  source: /note="Description of Artificial Sequence: Synthetic polynucleotide"

SEQ ID NO: 4646 - DNA, 495 bp, Artificial Sequence; identical to SEQ ID NO: 2366
  source: /note="Description of Artificial Sequence: Synthetic polynucleotide"

SEQ ID NO: 4647 - DNA, 495 bp, Artificial Sequence; identical to SEQ ID NO: 2367
  source: /note="Description of Artificial Sequence: Synthetic polynucleotide"

SEQ ID NO: 4648 - DNA, 495 bp, Artificial Sequence; identical to SEQ ID NO: 2368
  source: /note="Description of Artificial Sequence: Synthetic polynucleotide"

SEQ ID NO: 4649 - DNA, 495 bp, Artificial Sequence; identical to SEQ ID NO: 2369
  source: /note="Description of Artificial Sequence: Synthetic polynucleotide"

SEQ ID NO: 4650 - DNA, 495 bp, Artificial Sequence; identical to SEQ ID NO: 2370
  source: /note="Description of Artificial Sequence: Synthetic polynucleotide"

SEQ ID NO: 4651 - DNA, 495 bp, Artificial Sequence; identical to SEQ ID NO: 2371
  source: /note="Description of Artificial Sequence: Synthetic polynucleotide"

SEQ ID NO: 4652 - DNA, 495 bp, Artificial Sequence; identical to SEQ ID NO: 2372
  source: /note="Description of Artificial Sequence: Synthetic polynucleotide"

SEQ ID NO: 4653 - DNA, 495 bp, Artificial Sequence; identical to SEQ ID NO: 2373
  source: /note="Description of Artificial Sequence: Synthetic polynucleotide"

SEQ ID NO: 4654 - DNA, 495 bp, Artificial Sequence; identical to SEQ ID NO: 2374
  source: /note="Description of Artificial Sequence: Synthetic polynucleotide"

SEQ ID NO: 4655 - DNA, 495 bp, Artificial Sequence; identical to SEQ ID NO: 2375
  source: /note="Description of Artificial Sequence: Synthetic polynucleotide"

SEQ ID NO: 4656 - DNA, 495 bp, Artificial Sequence; identical to SEQ ID NO: 2376
  source: /note="Description of Artificial Sequence: Synthetic polynucleotide"

SEQ ID NO: 4657 - DNA, 495 bp, Artificial Sequence; identical to SEQ ID NO: 2377
  source: /note="Description of Artificial Sequence: Synthetic polynucleotide"

SEQ ID NO: 4658 - DNA, 495 bp, Artificial Sequence; identical to SEQ ID NO: 2378
  source: /note="Description of Artificial Sequence: Synthetic polynucleotide"

SEQ ID NO: 4659 - DNA, 495 bp, Artificial Sequence; identical to SEQ ID NO: 2379
  source: /note="Description of Artificial Sequence: Synthetic polynucleotide"

SEQ ID NO: 4660 - DNA, 495 bp, Artificial Sequence; identical to SEQ ID NO: 2380
  source: /note="Description of Artificial Sequence: Synthetic polynucleotide"

SEQ ID NO: 4661 - DNA, 495 bp, Artificial Sequence; identical to SEQ ID NO: 2381
  source: /note="Description of Artificial Sequence: Synthetic polynucleotide"

SEQ ID NO: 4662 - DNA, 495 bp, Artificial Sequence; identical to SEQ ID NO: 2382
  source: /note="Description of Artificial Sequence: Synthetic polynucleotide"

SEQ ID NO: 4663 - DNA, 495 bp, Artificial Sequence; identical to SEQ ID NO: 2383
  source: /note="Description of Artificial Sequence: Synthetic polynucleotide"

SEQ ID NO: 4664 - DNA, 495 bp, Artificial Sequence; identical to SEQ ID NO: 2384
  source: /note="Description of Artificial Sequence: Synthetic polynucleotide"

SEQ ID NO: 4665 - DNA, 495 bp, Artificial Sequence; identical to SEQ ID NO: 2385
  source: /note="Description of Artificial Sequence: Synthetic polynucleotide"

SEQ ID NO: 4666 - DNA, 495 bp, Artificial Sequence; identical to SEQ ID NO: 2386
  source: /note="Description of Artificial Sequence: Synthetic polynucleotide"

SEQ ID NO: 4667 - DNA, 495 bp, Artificial Sequence; identical to SEQ ID NO: 2387
  source: /note="Description of Artificial Sequence: Synthetic polynucleotide"

SEQ ID NO: 4668 - DNA, 495 bp, Artificial Sequence; identical to SEQ ID NO: 2388
  source: /note="Description of Artificial Sequence: Synthetic polynucleotide"

SEQ ID NO: 4669 - DNA, 495 bp, Artificial Sequence; identical to SEQ ID NO: 2389
  source: /note="Description of Artificial Sequence: Synthetic polynucleotide"

SEQ ID NO: 4670 - DNA, 495 bp, Artificial Sequence; identical to SEQ ID NO: 2390
  source: /note="Description of Artificial Sequence: Synthetic polynucleotide"

SEQ ID NO: 4671 - DNA, 495 bp, Artificial Sequence; identical to SEQ ID NO: 2391
  source: /note="Description of Artificial Sequence: Synthetic polynucleotide"

SEQ ID NO: 4672 - DNA, 495 bp, Artificial Sequence; identical to SEQ ID NO: 2392
  source: /note="Description of Artificial Sequence: Synthetic polynucleotide"

SEQ ID NO: 4673 - DNA, 495 bp, Artificial Sequence; identical to SEQ ID NO: 2393
  source: /note="Description of Artificial Sequence: Synthetic polynucleotide"

SEQ ID NO: 4674 - DNA, 495 bp, Artificial Sequence; identical to SEQ ID NO: 2394
  source: /note="Description of Artificial Sequence: Synthetic polynucleotide"

SEQ ID NO: 4675 - DNA, 495 bp, Artificial Sequence; identical to SEQ ID NO: 2395
  source: /note="Description of Artificial Sequence: Synthetic polynucleotide"

SEQ ID NO: 4676 - DNA, 495 bp, Artificial Sequence; identical to SEQ ID NO: 2396
  source: /note="Description of Artificial Sequence: Synthetic polynucleotide"

SEQ ID NO: 4677 - DNA, 495 bp, Artificial Sequence; identical to SEQ ID NO: 2397
  source: /note="Description of Artificial Sequence: Synthetic polynucleotide"

SEQ ID NO: 4678 - DNA, 495 bp, Artificial Sequence; identical to SEQ ID NO: 2398
  source: /note="Description of Artificial Sequence: Synthetic polynucleotide"

SEQ ID NO: 4679 - DNA, 495 bp, Artificial Sequence; identical to SEQ ID NO: 2399
  source: /note="Description of Artificial Sequence: Synthetic polynucleotide"

SEQ ID NO: 4680 - DNA, 495 bp, Artificial Sequence; identical to SEQ ID NO: 2400
  source: /note="Description of Artificial Sequence: Synthetic polynucleotide"

SEQ ID NO: 4681 - DNA, 495 bp, Artificial Sequence; identical to SEQ ID NO: 2401
  source: /note="Description of Artificial Sequence: Synthetic polynucleotide"

SEQ ID NO: 4682 - DNA, 495 bp, Artificial Sequence; identical to SEQ ID NO: 2402
  source: /note="Description of Artificial Sequence: Synthetic polynucleotide"

SEQ ID NO: 4683 - DNA, 495 bp, Artificial Sequence; identical to SEQ ID NO: 2403
  source: /note="Description of Artificial Sequence: Synthetic polynucleotide"

SEQ ID NO: 4684 - DNA, 495 bp, Artificial Sequence; identical to SEQ ID NO: 2404
  source: /note="Description of Artificial Sequence: Synthetic polynucleotide"

SEQ ID NO: 4685 - DNA, 495 bp, Artificial Sequence; identical to SEQ ID NO: 2405
  source: /note="Description of Artificial Sequence: Synthetic polynucleotide"

SEQ ID NO: 4686 - DNA, 495 bp, Artificial Sequence; identical to SEQ ID NO: 2406
  source: /note="Description of Artificial Sequence: Synthetic polynucleotide"

SEQ ID NO: 4687 - DNA, 495 bp, Artificial Sequence; identical to SEQ ID NO: 2407
  source: /note="Description of Artificial Sequence: Synthetic polynucleotide"

SEQ ID NO: 4688 - DNA, 495 bp, Artificial Sequence; identical to SEQ ID NO: 2408
  source: /note="Description of Artificial Sequence: Synthetic polynucleotide"

SEQ ID NO: 4689 - DNA, 495 bp, Artificial Sequence; identical to SEQ ID NO: 2409
  source: /note="Description of Artificial Sequence: Synthetic polynucleotide"

SEQ ID NO: 4690 - DNA, 495 bp, Artificial Sequence; identical to SEQ ID NO: 2410
  source: /note="Description of Artificial Sequence: Synthetic polynucleotide"

SEQ ID NO: 4691 - DNA, 495 bp, Artificial Sequence; identical to SEQ ID NO: 2411
  source: /note="Description of Artificial Sequence: Synthetic polynucleotide"

SEQ ID NO: 4692 - DNA, 495 bp, Artificial Sequence; identical to SEQ ID NO: 2412
  source: /note="Description of Artificial Sequence: Synthetic polynucleotide"

SEQ ID NO: 4693 - DNA, 495 bp, Artificial Sequence; identical to SEQ ID NO: 2413
  source: /note="Description of Artificial Sequence: Synthetic polynucleotide"

SEQ ID NO: 4694 - DNA, 495 bp, Artificial Sequence; identical to SEQ ID NO: 2414
  source: /note="Description of Artificial Sequence: Synthetic polynucleotide"

SEQ ID NO: 4695 - DNA, 495 bp, Artificial Sequence; identical to SEQ ID NO: 2415
  source: /note="Description of Artificial Sequence: Synthetic polynucleotide"

SEQ ID NO: 4696 - DNA, 495 bp, Artificial Sequence; identical to SEQ ID NO: 2416
  source: /note="Description of Artificial Sequence: Synthetic polynucleotide"

SEQ ID NO: 4697 - DNA, 495 bp, Artificial Sequence; identical to SEQ ID NO: 2417
  source: /note="Description of Artificial Sequence: Synthetic polynucleotide"

SEQ ID NO: 4698 - DNA, 495 bp, Artificial Sequence; identical to SEQ ID NO: 2418
  source: /note="Description of Artificial Sequence: Synthetic polynucleotide"

SEQ ID NO: 4699 - DNA, 495 bp, Artificial Sequence; identical to SEQ ID NO: 2419
  source: /note="Description of Artificial Sequence: Synthetic polynucleotide"

SEQ ID NO: 4700 - DNA, 495 bp, Artificial Sequence; identical to SEQ ID NO: 2420
  source: /note="Description of Artificial Sequence: Synthetic polynucleotide"

SEQ ID NO: 4701 - DNA, 495 bp, Artificial Sequence; identical to SEQ ID NO: 2421
  source: /note="Description of Artificial Sequence: Synthetic polynucleotide"

SEQ ID NO: 4702 - DNA, 495 bp, Artificial Sequence; identical to SEQ ID NO: 2422
  source: /note="Description of Artificial Sequence: Synthetic polynucleotide"

SEQ ID NO: 4703 - DNA, 448 bp, Artificial Sequence; identical to SEQ ID NO: 2423
  source: /note="Description of Artificial Sequence: Synthetic polynucleotide"

SEQ ID NO: 4704 - DNA, 495 bp, Artificial Sequence; identical to SEQ ID NO: 2424
  source: /note="Description of Artificial Sequence: Synthetic polynucleotide"

SEQ ID NO: 4705 - DNA, 495 bp, Artificial Sequence; identical to SEQ ID NO: 2425
  source: /note="Description of Artificial Sequence: Synthetic polynucleotide"

SEQ ID NO: 4706 - DNA, 495 bp, Artificial Sequence; identical to SEQ ID NO: 2426
  source: /note="Description of Artificial Sequence: Synthetic polynucleotide"

SEQ ID NO: 4707 - DNA, 495 bp, Artificial Sequence; identical to SEQ ID NO: 2427
  source: /note="Description of Artificial Sequence: Synthetic polynucleotide"

SEQ ID NO: 4708 - DNA, 495 bp, Artificial Sequence; identical to SEQ ID NO: 2428
  source: /note="Description of Artificial Sequence: Synthetic polynucleotide"

SEQ ID NO: 4709 - DNA, 495 bp, Artificial Sequence; identical to SEQ ID NO: 2429
  source: /note="Description of Artificial Sequence: Synthetic polynucleotide"

SEQ ID NO: 4710 - DNA, 495 bp, Artificial Sequence; identical to SEQ ID NO: 2430
  source: /note="Description of Artificial Sequence: Synthetic polynucleotide"

SEQ ID NO: 4711 - DNA, 495 bp, Artificial Sequence; identical to SEQ ID NO: 2431
  source: /note="Description of Artificial Sequence: Synthetic polynucleotide"

SEQ ID NO: 4712 - DNA, 495 bp, Artificial Sequence; identical to SEQ ID NO: 2432
  source: /note="Description of Artificial Sequence: Synthetic polynucleotide"

SEQ ID NO: 4713 - DNA, 495 bp, Artificial Sequence; identical to SEQ ID NO: 2433
  source: /note="Description of Artificial Sequence: Synthetic polynucleotide"

SEQ ID NO: 4714 - DNA, 495 bp, Artificial Sequence; identical to SEQ ID NO: 2434
  source: /note="Description of Artificial Sequence: Synthetic polynucleotide"

SEQ ID NO: 4715 - DNA, 495 bp, Artificial Sequence; identical to SEQ ID NO: 2435
  source: /note="Description of Artificial Sequence: Synthetic polynucleotide"

SEQ ID NO: 4716 - DNA, 495 bp, Artificial Sequence; identical to SEQ ID NO: 2436
  source: /note="Description of Artificial Sequence: Synthetic polynucleotide"

SEQ ID NO: 4717 - DNA, 495 bp, Artificial Sequence; identical to SEQ ID NO: 2437
  source: /note="Description of Artificial Sequence: Synthetic polynucleotide"

SEQ ID NO: 4718 - DNA, 495 bp, Artificial Sequence; identical to SEQ ID NO: 2438
  source: /note="Description of Artificial Sequence: Synthetic polynucleotide"

SEQ ID NO: 4719 - DNA, 495 bp, Artificial Sequence; identical to SEQ ID NO: 2439
  source: /note="Description of Artificial Sequence: Synthetic polynucleotide"

SEQ ID NO: 4720 - DNA, 495 bp, Artificial Sequence; identical to SEQ ID NO: 2440
  source: /note="Description of Artificial Sequence: Synthetic polynucleotide"

SEQ ID NO: 4721 - DNA, 495 bp, Artificial Sequence; identical to SEQ ID NO: 2441
  source: /note="Description of Artificial Sequence: Synthetic polynucleotide"

SEQ ID NO: 4722 - DNA, 495 bp, Artificial Sequence; identical to SEQ ID NO: 2442
  source: /note="Description of Artificial Sequence: Synthetic polynucleotide"

SEQ ID NO: 4723 - DNA, 495 bp, Artificial Sequence; identical to SEQ ID NO: 2443
  source: /note="Description of Artificial Sequence: Synthetic polynucleotide"

SEQ ID NO: 4724 - DNA, 495 bp, Artificial Sequence; identical to SEQ ID NO: 2444
  source: /note="Description of Artificial Sequence: Synthetic polynucleotide"

SEQ ID NO: 4725 - DNA, 495 bp, Artificial Sequence; identical to SEQ ID NO: 2445
  source: /note="Description of Artificial Sequence: Synthetic polynucleotide"

SEQ ID NO: 4726 - DNA, 495 bp, Artificial Sequence; identical to SEQ ID NO: 2446
  source: /note="Description of Artificial Sequence: Synthetic polynucleotide"

SEQ ID NO: 4727 - DNA, 495 bp, Artificial Sequence; identical to SEQ ID NO: 2447
  source: /note="Description of Artificial Sequence: Synthetic polynucleotide"

SEQ ID NO: 4728 - DNA, 495 bp, Artificial Sequence; identical to SEQ ID NO: 2448
  source: /note="Description of Artificial Sequence: Synthetic polynucleotide"

SEQ ID NO: 4729 - DNA, 495 bp, Artificial Sequence; identical to SEQ ID NO: 2449
  source: /note="Description of Artificial Sequence: Synthetic polynucleotide"

SEQ ID NO: 4730 - DNA, 495 bp, Artificial Sequence; identical to SEQ ID NO: 2450
  source: /note="Description of Artificial Sequence: Synthetic polynucleotide"

SEQ ID NO: 4731 - DNA, 495 bp, Artificial Sequence; identical to SEQ ID NO: 2451
  source: /note="Description of Artificial Sequence: Synthetic polynucleotide"

SEQ ID NO: 4732 - DNA, 495 bp, Artificial Sequence; identical to SEQ ID NO: 2452
  source: /note="Description of Artificial Sequence: Synthetic polynucleotide"

SEQ ID NO: 4733 - DNA, 495 bp, Artificial Sequence; identical to SEQ ID NO: 2453
  source: /note="Description of Artificial Sequence: Synthetic polynucleotide"

SEQ ID NO: 4734 - DNA, 495 bp, Artificial Sequence; identical to SEQ ID NO: 2454
  source: /note="Description of Artificial Sequence: Synthetic polynucleotide"

SEQ ID NO: 4735 - DNA, 495 bp, Artificial Sequence; identical to SEQ ID NO: 2455
  source: /note="Description of Artificial Sequence: Synthetic polynucleotide"

SEQ ID NO: 4736 - DNA, 495 bp, Artificial Sequence; identical to SEQ ID NO: 2456
  source: /note="Description of Artificial Sequence: Synthetic polynucleotide"

SEQ ID NO: 4737 - DNA, 495 bp, Artificial Sequence; identical to SEQ ID NO: 2457
  source: /note="Description of Artificial Sequence: Synthetic polynucleotide"

SEQ ID NO: 4738 - DNA, 495 bp, Artificial Sequence; identical to SEQ ID NO: 2458
  source: /note="Description of Artificial Sequence: Synthetic polynucleotide"

SEQ ID NO: 4739 - DNA, 495 bp, Artificial Sequence; identical to SEQ ID NO: 2459
  source: /note="Description of Artificial Sequence: Synthetic polynucleotide"

SEQ ID NO: 4740 - DNA, 495 bp, Artificial Sequence; identical to SEQ ID NO: 2460
  source: /note="Description of Artificial Sequence: Synthetic polynucleotide"

SEQ ID NO: 4741 - DNA, 495 bp, Artificial Sequence; identical to SEQ ID NO: 2461
  source: /note="Description of Artificial Sequence: Synthetic polynucleotide"

SEQ ID NO: 4742 - DNA, 495 bp, Artificial Sequence; identical to SEQ ID NO: 2462
  source: /note="Description of Artificial Sequence: Synthetic polynucleotide"

SEQ ID NO: 4743 - DNA, 495 bp, Artificial Sequence; identical to SEQ ID NO: 2463
  source: /note="Description of Artificial Sequence: Synthetic polynucleotide"

SEQ ID NO: 4744 - DNA, 495 bp, Artificial Sequence; identical to SEQ ID NO: 2464
  source: /note="Description of Artificial Sequence: Synthetic polynucleotide"

SEQ ID NO: 4745 - DNA, 495 bp, Artificial Sequence; identical to SEQ ID NO: 2465
  source: /note="Description of Artificial Sequence: Synthetic polynucleotide"

SEQ ID NO: 4746 - DNA, 495 bp, Artificial Sequence; identical to SEQ ID NO: 2466
  source: /note="Description of Artificial Sequence: Synthetic polynucleotide"

SEQ ID NO: 4747 - DNA, 495 bp, Artificial Sequence; identical to SEQ ID NO: 2467
  source: /note="Description of Artificial Sequence: Synthetic polynucleotide"

SEQ ID NO: 4748 - DNA, 495 bp, Artificial Sequence; identical to SEQ ID NO: 2468
  source: /note="Description of Artificial Sequence: Synthetic polynucleotide"

SEQ ID NO: 4749 - DNA, 495 bp, Artificial Sequence; identical to SEQ ID NO: 2469
  source: /note="Description of Artificial Sequence: Synthetic polynucleotide"

SEQ ID NO: 4750 - DNA, 495 bp, Artificial Sequence; identical to SEQ ID NO: 2470
  source: /note="Description of Artificial Sequence: Synthetic polynucleotide"

SEQ ID NO: 4751 - DNA, 495 bp, Artificial Sequence; identical to SEQ ID NO: 2471
  source: /note="Description of Artificial Sequence: Synthetic polynucleotide"

SEQ ID NO: 4752 - DNA, 495 bp, Artificial Sequence; identical to SEQ ID NO: 2472
  source: /note="Description of Artificial Sequence: Synthetic polynucleotide"

SEQ ID NO: 4753 - DNA, 495 bp, Artificial Sequence; identical to SEQ ID NO: 2473
  source: /note="Description of Artificial Sequence: Synthetic polynucleotide"

SEQ ID NO: 4754 - DNA, 495 bp, Artificial Sequence; identical to SEQ ID NO: 2474
  source: /note="Description of Artificial Sequence: Synthetic polynucleotide"

SEQ ID NO: 4755 - DNA, 495 bp, Artificial Sequence; identical to SEQ ID NO: 2475
  source: /note="Description of Artificial Sequence: Synthetic polynucleotide"

SEQ ID NO: 4756 - DNA, 495 bp, Artificial Sequence; identical to SEQ ID NO: 2476
  source: /note="Description of Artificial Sequence: Synthetic polynucleotide"

SEQ ID NO: 4757 - DNA, 495 bp, Artificial Sequence; identical to SEQ ID NO: 2477
  source: /note="Description of Artificial Sequence: Synthetic polynucleotide"

SEQ ID NO: 4758 - DNA, 495 bp, Artificial Sequence; identical to SEQ ID NO: 2478
  source: /note="Description of Artificial Sequence: Synthetic polynucleotide"

SEQ ID NO: 4759 - DNA, 495 bp, Artificial Sequence; identical to SEQ ID NO: 2479
  source: /note="Description of Artificial Sequence: Synthetic polynucleotide"

SEQ ID NO: 4760 - DNA, 495 bp, Artificial Sequence; identical to SEQ ID NO: 2480
  source: /note="Description of Artificial Sequence: Synthetic polynucleotide"

(The sequence listing continues in the following parts.)

The invention claimed is:

1. A method for determining non-uniform nucleic acid amplification potential among members of a set of oligonucleotide primers that is capable of amplifying rearranged nucleic acid molecules encoding one or more adaptive immune receptors in a biological sample from a mammalian subject, the method comprising:
  (a) amplifying a composition comprising a plurality of synthetic template oligonucleotides comprising sequences of rearranged nucleic acid molecules encoding one or more adaptive immune receptors and one or more additional unique random polynucleotide sequences using a set of oligonucleotide primers in a single multiplex PCR reaction to obtain a plurality of amplified synthetic template oligonucleotides;
  (b) sequencing said plurality of amplified synthetic template oligonucleotides to determine, for each unique synthetic template oligonucleotide comprising said plurality,
    (i) a synthetic template oligonucleotide sequence and
    (ii) a frequency of occurrence of said synthetic template oligonucleotide sequence; and
  (c) comparing a frequency of occurrence of each of said synthetic template oligonucleotide sequences to an expected distribution, wherein a deviation between said frequency of occurrence of said synthetic template oligonucleotide sequences and said expected distribution indicates a non-uniform nucleic acid amplification potential among members of the set of oligonucleotide amplification primers.

2. The method in claim 1, wherein said expected distribution is based on determining predetermined molar ratios of said plurality of synthetic template oligonucleotides comprising said composition.

3. The method of claim 2, wherein said predetermined molar ratios are equimolar.

4. The method in claim 1, wherein said expected distribution is determined based on quantifying frequencies of each unique synthetic template oligonucleotide.

5. The method of claim 1, wherein said expected distribution comprises a uniform amplification level for said plurality of synthetic template oligonucleotides amplified by said set of oligonucleotide primers.

6. The method of claim 1, further comprising adjusting the relative representation of the oligonucleotide primer member in the set of oligonucleotide amplification primers for each member of the set of oligonucleotide primers that exhibits non-uniform amplification potential relative to the expected distribution.

7. The method of claim 6, wherein adjusting comprises: increasing the relative representation of the member in the set of oligonucleotide primers, thereby correcting non-uniform nucleic acid amplification potential among members of the set of oligonucleotide primers, or decreasing the relative representation of the member in the set of oligonucleotide primers, thereby correcting non-uniform nucleic acid amplification potential among members of the set of oligonucleotide primers.

8. The method of claim 2, further comprising calculating a proportionately increased or decreased frequency of occurrence of the amplified template nucleic acid molecules for each member of the set of oligonucleotide amplification primers that exhibits non-uniform amplification potential relative to the expected distribution, thereby correcting for non-uniform nucleic acid amplification potential among members of the set of oligonucleotide primers.

9. The method of claim 1 wherein each amplified synthetic template nucleic acid molecule is less than 1000, 900, 800, 700, 600, 500, 400, 300, 200, 100, 90, 80 or 70 nucleotides in length.

10. The method of claim 1 wherein said set of oligonucleotide primers does not include oligonucleotide primers that specifically hybridize to a V-region pseudogene or orphon or to a J-region pseudogene or orphon.

11. The method of claim 1 wherein said plurality of synthetic template oligonucleotides each comprise an oligonucleotide sequence of a general formula:

$$5'\text{-U1-B1-V-B2-R-B3-J-B4-U2-3'} \qquad [I]$$

wherein:
  (a) V is an oligonucleotide sequence comprising at least 20 and not more than 1000 contiguous nucleotides of an adaptive immune receptor variable (V) region encoding gene sequence, or the complement thereof, and each V comprising a unique V-region oligonucleotide sequence;
  (b) J is an oligonucleotide sequence comprising at least 15 and not more than 600 contiguous nucleotides of an adaptive immune receptor joining (J) region encoding gene sequence, or the complement thereof, and each J comprising a unique J-region oligonucleotide sequence;

(c) U1 is either nothing or comprises an oligonucleotide sequence that is selected from (i) a first universal adaptor oligonucleotide sequence and (ii) a first sequencing platform-specific oligonucleotide sequence that is linked to and positioned 5' to a first universal adaptor oligonucleotide sequence;

(d) U2 is either nothing or comprises an oligonucleotide sequence that is selected from (i) a second universal adaptor oligonucleotide sequence, and (ii) a second sequencing platform-specific oligonucleotide sequence that is linked to and positioned 5' to a second universal adaptor oligonucleotide sequence;

(e) at least one of B1, B2, B3, and B4 is present and each of B1, B2, B3, and B4 comprises an oligonucleotide comprising a barcode sequence of 3-25 contiguous nucleotides, that uniquely identifies, as a paired combination, (i) the unique V-region oligonucleotide sequence of (a) and (ii) the unique J-region oligonucleotide sequence of (b);

(f) R is either nothing or comprises a restriction enzyme recognition site that comprises an oligonucleotide sequence that is absent from (a)-(e); and (g) one or more unique random polynucleotide sequences positioned between or within components of formula I.

12. The method of claim 11 wherein the one or more unique random polynucleotide sequences each comprises at least 2, 3, 4, 5, 6, 7, 8, 9, 1,0 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 70, 80, 90, 100, 200, 300, 400, 500 or more contiguous nucleotides.

13. The method of claim 11 wherein the plurality of synthetic template oligonucleotides comprises a number of at least a or at least b unique oligonucleotide sequences, whichever is larger, wherein a is the number of unique adaptive immune receptor V region-encoding gene segments in the subject and b is the number of unique adaptive immune receptor J region-encoding gene segments in the subject, and the composition comprises at least one synthetic template oligonucleotide for each unique V-region oligonucleotide sequence and at least one synthetic template oligonucleotide for each unique J-region oligonucleotide sequence.

14. The method of claim 13, wherein a ranges from 1 to a number of maximum V gene segments in the mammalian genome of the subject.

15. The method of claim 13, wherein b ranges from 1 to a number of maximum J gene segments in the mammalian genome of the subject.

16. The method of claim 13, wherein the plurality of template oligonucleotides comprises at least (a ×b) unique oligonucleotide sequences, where a is the number of unique adaptive immune receptor V region-encoding gene segments in the mammalian subject and b is the number of unique adaptive immune receptor J region-encoding gene segments in the mammalian subject, and the composition comprises at least one template oligonucleotide for every possible combination of a V region-encoding gene segment and a J region-encoding gene segment.

17. The method of claim 11, wherein J comprises an oligonucleotide sequence comprising a constant region of the adaptive immune receptor J region encoding gene sequence.

18. The method of claim 1, wherein the one or more adaptive immune receptors is selected from the group consisting of TCRB, TCRG, TCRA, TCRD, IGH, IGK, and IGL.

19. The method of claim 11, wherein the V oligonucleotide sequence of (a) encodes a TCRB, TCRG, TCRA, TCRD, IGH, IGK, or IGL receptor V-region polypeptide.

20. The method of claim 11, wherein the J oligonucleotide sequence of (b) encodes a TCRB, TCRG, TCRA, TCRD, IGH, IGK, or IGL receptor J-region polypeptide.

21. The method of claim 11, further comprising a stop codon sequence between V and B2.

22. The method of claim 11, wherein V is an oligonucleotide sequence comprising at least 30 contiguous nucleotides of the adaptive immune receptor V region encoding gene sequence, or the complement thereof.

23. The method of claim 11, wherein V is an oligonucleotide sequence comprising not more than 900, 800, 700, 600 or 500 contiguous nucleotides of an adaptive immune receptor V region encoding gene sequence, or the complement thereof.

24. The method of claim 11, wherein J is an oligonucleotide sequence comprising at least 16 contiguous nucleotides of an adaptive immune receptor J region encoding gene sequence, or the complement thereof.

25. The method of claim 11, wherein J is an oligonucleotide sequence comprising not more than 500 contiguous nucleotides of an adaptive immune receptor J region encoding gene sequence, or the complement thereof.

26. The method of claim 11, wherein each synthetic template oligonucleotide is less than 1000, 900, 800, 700, 600, 500, 400, 300 or 200 nucleotides in length.

27. The method of claim 1 wherein said one or more additional unique random polynucleotide sequences each comprises at least 2 contiguous nucleotides.

\* \* \* \* \*